United States Patent 12,569,549 (FLAVIVIRUS VACCINE) - sequence listing, part 77

SEQ ID NO: 26132 - RNA, 9873 nt, synthetic construct
  misc_feature 1..9873: note = derived and/or modified CDS sequence (opt11) from DENV-3__FJ461338__SS-prME
  source 1..9873: mol_type = other RNA
acgagtctgtgccttatgatgatgctgcccgccaccctggcattccatctaaccagccgggacggtgagccacgtatgatcgtaggaaagaacgagcggggcaagagcctcctgttcaagaccgcgtccggtataaacatgtgcaccctcatcgccatggatctgggcgagatgtgcgacgacaccgtgacgtacaagtgccctctggttgctgaggtagagcctgaggacatagactgctggtgcaacttgaccagcacttgggtgacatacgggacatgcaaccaggcaggcgagcacaggcgcgacaagagatccgtcgcattagctccccatgtgggcatggggctggacacccgtacccagacttggatgtcagcggagggagcttggcgacaggtagaaaaggtagagacgtgggcgctccgccaccctggtttcaccatcctggccctgttccttgcccactatatcggcacctccctgactcagaaggtcgtcatcttcatcctactcatgctggtgacgccctctatgaccatgcggtgcgtgggggtgggaaacagggacttcgtggaaggcctctccggagcaacctgggttgacgtagtgttagaacacggcgggtgcgtcacgacgatggcaaaaaacaaacccaccctggatatcgagctgcagaagactgaagccacccagctcgcaacgctgcggaagctgtgcatagagggcaagatcaccaacatcaccaccgacagccggtgtcccacacagggcgaggcgattttgccggaagaacaagaccaaaattatgtttgcaaacatacctacgtggaccgtgggtggggcaacgggtgcggcctatttggaaagggttccctggtaacctgtgccaagttccagtgtttggaacccatcgagggtaaagtcgtgcaatatgagaacctcaagtacaccgtgataatcacggtccatactggagaccagcaccaagtgggtaacgacacccagggggtcaccgtggagatcacgccccaggcgagtaccgtcgaggccgtgctgccagaatacggcacactcgggcttgaatgtagtcccaggacaggtctggactttaatgagatgatcctcttaactatgaagaacaaagcgtggatggtgcaccgacagtggtttttcgaccttccgctcccctggacgagcggcgccaccaccgagacgccgacatggaataaaaaggagctcctcgtaacttttaagaacgcccacgccaaaaagcaggaggttgtagttctcgggtcgcaggagggagccatgcacaccgcgctgaccggcgccactgagatccagaatagcggcgggacctccatatttgccggacacctgaagtgccgcctaaagatggacaagctagagcttaagggcatgagctacgccatgtgtctgaacaccttcgttctgaagaaagaggtgagcgagacccaacacgggacgatcttaatcaaagttgagtacaagggcgaggacgccccgtgtaagatccctttctctaccgaggacggacaaggcaaagcccataacggcaggctgatcaccgccaatccggtcgtcacaaagaaggaggagcctgtcaacatcgaagccgaaccaccgttcggggagtcaaacatagtcattggtatcggtgacaaggccctaaaaatcaactggtacaaaaagggctccagcatcgggaagatgtttgaggctacggcccggggcgcaaggcgcatggccatcctgggagacacggcctgggacttcggttccgtaggcggagtgctgaactcgttgggcaagatggtccaccagattttcggttcagcatacaccgcccttttctctggcgtgtcatggataatgaaaatcggcatcggagtgctgctcacgtggatagggcttaacagcaagaatacgtccatgtcgttttcatgcatcgtgatcgggattatcaccctgtatctaggcgccgtggtgcaggccgacatggggtgcgctatcaactggaagggcaaagagttgaagtgcggtagcgggatctttgtcaccaatgaagtgcacacctggaccgagcaatacaagttccaggccgattccccgaaacggctagctacggccatcgccggggcctgggaaaatggagtctgtggcattcgctccaccactcgcatggagaacttgttgtggaagcaaatcgcgaacgagctgaattacatcctctgggaaaacaacataaagctcacggtagttgtcggggacattatcggcgtactggagcagggcaagaggactctcacgcctcagccgatggagctgaagtacagctggaagacctggggaaaggccaagatcgtgactgcggagactcagaatagtagtttcatcatcgatggccctaacactcccgagtgccccagcgcgagtcgcgcgtggaacgtgtgggaggtcgaggactacgggttcggcgtgttcaccacgaacatctggctaaagctccgggaggtctacacccagagctgcgaccaccgcctgatgagcgcggcgatcaaggatgagcgcgcagtccatgccgacatgggctactggatcgaatcccaaaaaaacggcagctggaagttggagaaagcgtccttcatcgaggtaaagacctgtacctggcccaagtcacacaccctgtggtccaacggcgtgctggaaagcgacatgatcatccccaaatccctggcggggcccatctctcagcataatcaccgacctgggtaccacacgcagaccgccgggccctggcatctcggcaaattggagctggattttaactactgtgagggtacgaccgtcgttatcacggagaactgtgggactcgggggcccagtctccgcaccaccactgtgagcgggaagctgatccatgagtggtgctgccggtcatgcacactgccccccctcaggtacatgggcgaggacgggtgctggtacggcatggagatcagacctatcaacgaaaaggaagaaaacatggtcaagagcttggtgtccgccgggagcgggaaggtggacaacttcaccatgggcgtcctgtgcctcgccatcctgttcgaggaagtgatgagaggcaagttcggcaaaaagcacatgattgcgggggtgcttttcacattcgtcctcttactgtctggccagatcacgtggagggacatggcccacactctcatcatgataggctcaaacgcctccgaccgcatgggcatgggcgtgacctacctggccctgatcgctaccttcaagatccagcccttcctcgccttagggttcttcctgcgaaagttgacaagtcgcgagaacttactgctgggggtagggctcgccatggcaaccactctacagcttccggaggatatcgagcaaatggcgaacgggattgctctgggcctaatgaccctcaaactgatcacccagtttgagacctaccaactgtggaccgcgctcgtcagcttgacttgctccaacacgatattcacattgacggtggcctggaggacggctacgctcatcctggccggagtcagcctgctcccgctgtgtcaatccagctcaatgcgaaagaccgactggcttcccatgacggtggccgccatgggcgtgccgccactgccgttgttcatcttctcgctgaaagacaccccgaagcggcgcagttggcccctgaacgagggggtcatggccgtgggcctagttagcatcttagcctcctcacttctgaggaatgacgtacccatggccggccctctagtggcgggggggctcctaatcgcctgctacgtcatcacaggtacaagcgcggacctgaccgtcgaaaaggccgccgacgtcacgtgggaagaggaggccgagcagactggcgtgtcacacaacctaatgatcacagtcgacgacgatgggaccatgcgaatcaaagacgacgagaccgagaacatcctgaccgtgctgctcaagactgccctgttgatcgtctcaggcatcttcccatacagcatccccgcgaccttgctagtctggcacacctggcagaagcagactcagcgatctggcgtgctgtgggacgtacccagtccgccggagacgcaaaaggccgaactggaagagggagtctaccggatcaagcaacagggaatcttcgggaagacccaggtgggtgtgggggtccagaaggagggcgtgttccataccatgtggcacgttactcgcggcgccgtcctgacgcacaatggtaagcgactggaacccaactgggcgtccgtgaagaaggacctcatatcttacggcggagggtggcgactgtccgcccagtggcagaagggcgaggaagttcaggtcatcgctgtggagcccggcaagaatccaaagaacttccaaacaatgcccggcatcttccaaaccaccaccggagagatcggcgccatcgcgctggactttaagcccggaaccagcggcagtccgatcattaaccgggagggtaaggtggtcgggctgtatggcaacggcgtggttactaagaacggcgggtacgtctcaggaatcgctcagaccaacgccgagcccgatggccccacgccggagctcgaggaggagatgttcaagaagagaaaccttactataatggacctccacccggggagcggcaagacaaggaaatatctccccgctattgtgcgcgaggccataaaacggagacttcgcaccctgatccttgcccccacacgggtagtggccgccgagatggaggaggccctgaaggggcttcctattcggtaccaaaccacagccacaaaatccgaacacacgggacgcgagatcgtcgaccttatgtgccatgcgacctttaccatgcggctgttatcacccgtccgcgtccccaactataacctcatcatcatggacgaggcccactttaccgatcccgcttccatcgcagcccgggggtatattagcacgcgcgttgggatgggcgaggcggctgcaattttcatgaccgcgacgcctccgggtacagcggaggctttcccccaatccaacgcccccatacaggacgaagagagagacatcccagaacgctcttggaactccggcaacgaatggatcacggacttcgtgggcaaaacggtctggtttgtgcccagcattaaagccgggaacgacatagccaactgtcttcgcaagaacgggaagaaggtgattcagctgtcccggaaaaccttcgacaccgaataccagaagacgcgcctgaatgattgggattttgtagtgaccaccgacatctccgagatgggcgcgaatttcaaagccgatcgggtgatcgatccgcgccgatgcctgaagcccgtcatcctgaccgatggtccggaacgcgtgatcctcgccggaccgatgcctgttacggccgcttccgcagcccagcggcgcggccgggtcgggcgcaacccccagaaagagaacgaccagtacatattcaccggccagcccctgaacaatgacgaggatcacgcccactggacggaagcgaagatgctgcttgacaacatcaacaccccggaagggatcatccccgccttgttcgaacccgagcgggagaagtccgcggccatagacggggagtatcgcttgaagggcgaatcccgaaagaccttcgtggagctcatgcgccgcggggacctcccggtctggctggcccacaaagtggccagcgagggcatcaaatacaccgaccgcaagtggtgcttcgacggagaacgaaataatcaaatcctcgaggagaacatggatgtggagatttggacaaaggaaggggagcgcaagaagttgcggccgcgctggctggacgcgcggacttatagtgatcccctcgcgctgaaggaattcaaggacttcgccgctggccgcaaatccattgccctcgacctcgtcactgagatcgggcgggtgccctcccacctggcataccgcacgagaaacgcgctcgacaacttagtgatgctgcacacctctgaacatggcggtagagcctatcgccatgccgtcgaggagcttccggaaaccatggagaccctcctgctgttgggcctgatgatcctgttaaccggcggggcaatgctgttcctgatttctgggaaggggatcggtaagacctccattgggctcatctgcgtcatcgtgtctagtggcatgctgtggatggcggacgtccctctgcagtggatcgcaagcgccatcgtgttggagttcttcatgatggttctgttaatccccgagcccgagaagcaacggactccgcaggacaaccagcttgcctatgtcgtaatagggattctgaccctggccgctatcgtggccgcaaacgagatgggcctcctggagacgaccaagcgcgacctgggcatgtccaaggagcccggtgtcgtcagccccacctcctacctcgacgtcgacctgcaccccgcatcggcctggaccttatacgcggtagcgaccaccgttatcacgccaatgttgcggcacaccatcgaaaattctacggcaaatgtcagcctagctgcaatcgcgaaccaagccgtcgtgctcatggggcttgataagggatggcccatctccaagatggacctgggagtaccactactagctctcgggtgttacagccaagtaaatcccctaacccttaccgcagcggtgctactgctagttacccactacgccattatcggccctggcctgcaggcgaaggccacgcgagaggctcaaaagcggaccgcggctgggatcatgaaaaatcccaccgtcgacggcattatgacaatcgacctagacccagtgatctacgatagcaagttcgaaaagcagctcggccaggtgatgctgctggtcctctgcgccgtacaactgttgctgatgcgcacgagctgggccctgtgtgaggccctcacccttgcgactggccccatcaccaccctgtgggaaggctcgccggggaagttttggaacaccacaatcgccgtgtctatggccaacatattccggggctcataccttgcgggggctgggttggccttcagcattatgaagtccgtagggacaggccgtcggggcacgggaagccagggcgaaaccttgggtgagaagtggaaaaagaagctaaaccagctctccagaaaggaattcgacctgtacaaaaagtccggtattaccgaggtagaccggaccgaggctaaagaaggcctgaaacgcggcgagactacacaccacgccgtgagccggggctccgccaagctccaatggttcgtcgagcgcaacatggtgatcccggaggggcgggtgatagacctgggctgcgggcgcggtgggtggagctactactgcgctggactaaagaaggtcaccgaagtgcgcggctacaccaagggcgggcctggccacgaggagccagtgccgatgagtacctacggctggaacatcgtcaagctcatgtctggtaaggacgtgttttatcttccacctgagaagtgcgacacactactgtgcgacattggtgaatccagcccctccccgaccgtggaggaaagccggacaatccgcgtcctcaagatggtggaaccctggctgaagaataaccagttctgcatcaaagtcctgaacccttatatgccaaccgtcatagagcacctcgagcgactgcagcgcaagtacggcggaatgcttgttcggaaccctctctcccgcaacagcactcacgagatgtactggatctccaacggcactggcaatatcgtgtcctccgtcaacatggtgtcacgactgctgcttaaccgcttcaccatgacccaccgacgccccacgatcgagaaggatgtggacctgggcgcgggcacccggcacgtgaacgccgagcctgagaccccgaatatggatgtgataggggaacgtatcaagagaattaaggaagagcattcgagtacatggcactacgacgacgagaacccctacaagacgtgggcctaccacggctcctatgaagtcaaggccacagggagcgcatcctcaatgatcaacggcgtggtgaagctgctaaccaagccctgggacgtagtgccgatggtgacccagatggctatgactgacaccaccccctttgggcaacagcgcgttttcaaagagaaggtggacacccggacgcccaggcccatgcccgggacccgaaaggtgatggagatcaccgccgagtggctgtggcgcactctgggccgtaacaagaagccacgcctctgcacaagagaggagttcacgaagaaggtccggaccaacgccgccatgggcgctgtgttcaccgaggagaaccagtgggattctgcccgcgccgccgtcgaggacgaggagttctggaaattagttgaccgggaacgcgagctacacaagctcggtaaatgcggaagctgtgtctataatatgatgggcaagcgggagaagaagctgggggagttcggcaaggccaaaggctcccgcgctatctggtatatgtggctgggggcccgttacctcgagttcgaggcactaggcttcctgaacgaggaccactggttctcccgtgagaacagctactcaggggtagagggagaggggctccacaagcttggctatattctgcgggacataagtaaaatccccggcggggcaatgtacgcagacgacacggccgggtgggatacacgcatcacagaggacgacctgcacaatgaggaaaagatcactcagcagatggaccccgagcaccggcaacttgccaacgcaatcttcaaactaacataccagaacaaggtcgtgaaggttcagcgtccgaccccgaaggggaccgtcatggacattatctcccgtaaagaccaacgaggcagcggtcaagtggggacatacggcctaaacaccttcaccaacatggaggcccagttagtgcgccagatggagggggagggagtgctgagtaaagcggacctcgagaacccacacctattagagaaaaagataacgcagtggcttgagaccaagggtgtggaacgcctgaagcggatggccatctctggcgacgactgcgtggtcaaacccatcgacgacaggttcgccaatgcccttctcgctcttaacgacatgggcaaggtacggaaagacatcccccagtggcaaccgtccaagggttggcatgattggcaacaagtaccgttctgctcacaccactttcacgagttaatcatgaaggatgggcgcaagttggtcgtgccctgccggccccaggacgaactaattggtcgcgctagaatctcccagggagccgggtggagcctgaaggagaccgcatgcctcggcaaggcctacgcacagatgtggtctttgatgtacttccaccggcgcgatctgcgcttagcgagcaacgcgatctgctccgccgtcccagtccattggatcccgacgtcacgcactacgtggagcatccatgcccatcaccagtggatgaccacggaggacatgctgaccgtgtggaaccgggtgtggatagaggacaacccctggatggaggacaagacccccgtcacgacctgggaagacgtcccttatctcggcaaacgcgaggatcagtggtgcggctcgctcatcgggcttacctcgcgtgcgacctgggcccagaacatcctgaccgccatccaacaggtccgctccctaataggggacgaggagtttctggactatatgcccagcatgaagcggttccgaaaagaggaggagagcgagggagccatctggtga

SEQ ID NO: 26133 - RNA, 9873 nt, synthetic construct
  misc_feature 1..9873: note = derived and/or modified CDS sequence (opt11) from DENV-3__FJ562103__SS-prME
  source 1..9873: mol_type = other RNA
acctccttatgcctcatgatgatgctgcccgcgacgctggcctttcacctcacaagccgcgatggcgaaccgcgaatgatcgtcgggaagaacgaaaggggcaagtccctgctgttcaagacagcgtccggcattaacatgtgcaccttgatcgccatggacctgggggaaatgtgtgacgacaccgtcacctaccggtgccccttaatcgccgaggtggaacccgaagatatcgactgttggtgtaacctcaccagcacctgggtgacctacggaacatgcaaccaggccggtgaacaccgccgggataagcgcagtgtggccctagcgccccacgttggcatgggactggacacccggacccagacttggatgagcgccgagggtgcctggcgccaggtggagaaggtggagacctgggcacttcggcaccctggttttaccatcctggcgctattcctcgcccactatatcggaacatccctgacccagaaggtggtgattttcacgctgctcatgctggtcacccccagcatgaccatgcgctgtgttggagtaggcaaccgtgactttgtcgaaggcctttccggggccacctgggtggacgtggtccttgagcacggcgggtgcgtgacgaccatggccaagaacaagcccaccctggacatcgagctgcaaaagacggaggcaacgcagctcgcgactctgcgcaagctgtgcatagagggcaagatcaccaacataaccacagacagccgttgccccacgcaaggcgaggcgatcttgccagaggagcaagaccagaattacgtgtgcaagcacacctacgtcgaccgcggttggggcaacgggtgcggcttatttgggaagggctcgctggtgacctgcgcaaagtttcaatgcctcgagcccattgagggaaaagtggtccagtacgagaatctcaagtacaccgttatcatcaccgtgcacaccggtgaccagcaccaggtcggcaacgacacacaaggtgtaacggtggagataacaccccaggccagcaccgtggaagcggtcctgcccgagtacggcaccctcgggctggagtgctccccgaggaccggcctggatttcaatgagatgatactcctgacgatgaagaataaggcgtggatggtacaccgccagtggttcttcgacttgccactaccctggacctccggcgctaccaccgaaacgcccacgtggaaccggaaggaactgctggtgaccttcaagaacgctcatgcgaagaaacaggaggtggtcgtgctcggctcccaggagggcgccatgcacaccgcgttgaccggggcaaccgagattcagaatagcggcgggaccagcatcttcgctggccatctgaagtgtcgcttaaagatggacaagctcgagctcaagggcatgagctacgccatgtgtctgaataccttcgttctgaagaaagaggttagtgagacgcagcacgggacaatactaatcaaggtagagtataagggtgaggacgccccgtgcaagattcccttcagcaccgaggacggacagggcaaggcgcacaatggccggctgatcacggcaaatcctgtggtcactaagaaggaggagcccgtgaacatcgaggcagagccgccctttggggagagcaacatcgtcataggcataggaaacaaggccctcaaaattaactggtacaagaaggggtctagcatagggaagatgttcgaggcgaccgcaagaggggcacggcgcatggccatcctgggcgacactgcttgggacttcggttctgtcggcggggtgctgaatagcctcggaaaaatggtgcaccagatcttcgggtccgcgtacacagcgttattcagcggcgtttcctggattatgaagatcggcatcggggtcctgctcacatggatcggcctgaacagcaaaaacacctccatgtcgtttagttgtatcgtgatcgggataatcacattatacctaggcgcggttgtgcaggcagacatggggtgtgccatcaactggaagggcaaggagttaaagtgcggaagcgggatattcgtgaccaacgaggtgcacacgtggaccgaacagtataagttccaggcggattcgcccaagcgcctagccaccgcaatagccggcgcttgggagaacggcgtctgcggcatccgtagcaccacccgaatggagaacctactgtggaagcagattgccaacgaattaaactacatcttgtgggagaacaacatcaagctcaccgtggtcgttggggacatcataggcgtactagagcaggggaagcggactcttacgccccaaccgatggaactgaagtactcctggaagacctggggtaaggccaagatcgtcaccgccgagacccagaatagctccttcataatcgacggccctaacacccctgagtgccccagcgccagccgcgcgtggaacgtctgggaggtggaggactacggtttcggcgtcttcactactaatatttggctgaagttgcgggaggtgtacacccaaagctgcgaccaccgcctgatgtcagctgcgatcaaagatgagagagccgtgcacgccgacatgggctactggattgagagtcagaagaacgggtcttggaaactagaaaaggcatccttcatcgaggtcaagacttgcacatggcccaagagccacaccctatggtccaacggcgtgctggagagtgatatgatcatccccaagtccctagccggccctatcagccagcacaaccaccgcccgggttaccatacacagaccgcagggccctggcaccttggcaagctggaacttgactttaactactgtgagggtacaacggtcgtcatcactgaaaattgcggcacccggggcccctccctgcgcaccaccaccgtgtccgggaagctgatccacgagtggtgctgccggagttgcaccctgcccccgctgcgctacatgggagaggacgggtgctggtatggcatggagatcagaccaatcaacgagaaggaggagaacatggtgaaaagcctggtatccgccggcagcggtaaggtagataacttcaccatgggcgtgctctgcctcgccatcctgttcgaggaggtcatgcgcgggaagttcggcaagaagcatatgatcgcgggcgtgctttttactttcgttcttctgctatcaggccagatcacgtggcgtgacatggcccacacactaatcatgatcggctcgaatgcctccgaccgcatgggcatgggcgtcacctacctggccctgatcgccacgtttaagatccagcccttcctcgcgcttgggttcttcttacggaagctcaccagccgggagaacctgctgctcggcgtcggcctggccatggccacgaccttgcaactccccgaggacatagagcaaatggccaacgggatcgcactgggcctgatgacgctcaagctgatcacccagttcgagacctaccagctgtggactgccttggtgagcctaacgtgttccaatacaatcttcaccctgacggtcgcctggcggacggccaccttgatcctggccggggtgagcctgctcccgctctgccaaagttcatcgatgcgcaaaacagactggctaccaatgactgtcgcggctatgggcgtgccccctctgccgttattcatcttcagcttgaaggacacgcctaagcgccggtcgtggcccctcaatgagggggtgatggccgtcggtctggtgagcatactggcctcctctctcctgcggaacgacgtacccatggccggcccgctggtcgccggaggcctcttaatcgcctgctacgtgatcacagggaccagcgccgaccttaccgtggagaaggcagccgatgtaacgtgggaggaggaagccgagcagaccggcgtgagccacaacctcatgatcacggtggacgacgacgggaccatgcgaatcaaggacgacgagacagagaacattctgacggtcttactcaagaccgccctgctgatagtgtcgggcatttttccctacagcatccccgccactcttctggtgtggcacacctggcagaagcaaacgcaacgctccggcgtgctgtgggacgtacctagtccacccgagacccagaaggccgagctcgaggagggggtgtacagaatcaagcagcaaggcatctttgggaagacccaggtcggggtgggggttcaaaaagagggagtgttccacacgatgtggcacgtaacgcgtggagccgtgctgacccataacgggaagcggctggagccgaactgggccagcgttaagaaagacctcatctcatacggcgggggttggcgcctttcagcgcagtggcaaaagggggaggaggtgcaggtaatcgccgtagagcccggcaagaaccctaagaacttccagaccatgcccggtatctttcagacaacaaccggggagattggcgccatcgcactggactttaaacccggaaccagcgggagcccaatcatcaaccgggagggcaaggtggtgggtctttacggtaacggagtcgtgaccaagaacggcggttacgtgtccggcatcgcccaaactaacgctgagcccgacgggcccacccccgagctcgaggaggagatgttcaagaagcgtaacctgaccatcatggacctgcacccgggaagtggcaagacccggaaatacttaccagccatagtacgggaggcaatcaagcggaggctgcggacgttgatcctcgcgcccaccagagtcgtggccgctgagatggaggaggcattgaaggggctacccatcaggtaccagaccaccgcaacgaagtccgagcacaccggccgggagatcgtggacctcatgtgccatgcgaccttcaccatgcggctgctgtccccggtgcgcgtccccaactacaatctcatcatcatggacgaggcccacttcacggaccccgcctctatcgccgcccgggggtatatcagcacccgcgtcggcatgggcgaggcggccgccattttcatgacagcaacgccgcccgggacggctgaggccttccctcagtccaacgcccccatccaggatgaggagaaagacatccccgagcgttcttggaactccggcaacgagtggatcaccgacttcgtagggaagactgtctggttcgtcccgagcatcaaggccggcaatgacattgccaactgtcttcgaaagaacggcaaaaaggtgatccagctgtccaggaagaccttcgacactgagtaccagaagacccggctcaacgactgggactttgtggtcaccaccgacatcagcgagatgggcgccaatttcaaggccgaccgcgtcatcgacccccggcgctgcctgaagcccgtgatcttaacggacggccccgagagagtgatcctcgccgggcccatgcctgttactgctgcctccgctgcccaacgccggggccgtgtgggccggaacccccagaaggagaacgaccagtacatcttcaccggccagcccctgaacaacgacgaagatcacgcccactggaccgaggccaagatgctattggacaatatcaacaccccggaagggattatcccggccctgttcgagcctgagcgcgaaaagtccgcagccatcgatggggagtatcggctgaagggggagtcccgcaaaacgttcgtcgaactcatgcggcgcggggacctaccggtgtggctagcgcacaaggtggcatcagagggcataaagtacaccgatcggaagtggtgtttcgacggcgaacgcaacaaccaaatcctcgaggagaatatggatgtggagatttggaccaaggaaggcgaacggaagaaactgcgcccccgctggctggacgcgcggacatactccgatcctctcgccctgaaggagttcaaggacttcgctgccggcaggaaaagcattgccttggacctcgtgaccgagatcgggcgagtgccctcacacctggcgtacaggaccagaaacgctctggacaatcttgtgatgctgcacaccagcgagcacggcgggcgcgcgtatcggcacgccgtggaggaactgccggagaccatggaaactctcctgttactcgggctgatgatccttctcaccgggggagcgatgttattcctgatttcgggcaaagggatcggcaagacctccatcggcctcatctgtgttatagtctccagtggcatgctgtggatggcggacgtgcccctccagtggatcgcctctgctatagtcctagagttctttatgatggtgctgctgatccccgagccggagaagcagaggacacctcaggataaccagttggcttacgtggtcatcgggatcctgactctggccgcaatcgtggctgccaacgagatgggcctcttagagaccaccaagcgggatctcggcatgagtaaagagcccggggtggtcagtcccacctcctacctcgatgtagatttgcaccccgcttcggcctggacgctctacgcggtggccaccacagtcatcactcctatgctccgtcacacgattgaaaattccacagccaacgtgagccttgcggcgatcgctaaccaggcagtggttcttatgggactcgataaagggtggcccatttctaagatggatctcggtgtcccccttctcgccctggggtgctacagccaggtgaaccctctgacccttaccgccgccgtgttattactcgttacgcattatgcgatcattggccctggtctgcaggcgaaggccacccgggaagcccaaaagcgcaccgcagcagggatcatgaagaaccccacggtggacggcatcatgacgatcgaccttgaccccgtcatctacgattcgaagttcgaaaaacagctcggacaggtgatgttattggtgctctgcgccgtgcagctgttactcatgcggaccagctgggccctgtgcgaggccctaaccctggcgacgggccccattacgaccctgtgggagggctcgccgggcaagttctggaataccaccatcgctgtgagcatggccaatatcttccgcggctcctatctagccggggcgggcctcgccttttctatcatgaagtcggtggggacgggccggcggggaaccggcagtcagggcgaaaccctcggtgagaagtggaagaagaagctgaaccagctctctcgtaaggagttcgacctctacaagaagtccggaatcacagaggtggaccgcactgaagccaaggaaggtctgaagcgtggcgaaactacacaccacgccgtgagccgcggctccgcgaagctccaatggttcgtggaacgtaacatggtaatacccgaggggcgcgtaatcgaccttggctgcgggcgagggggttggagctattactgcgcgggcctgaaaaaggtgaccgaggtccgtggctacaccaagggaggacccggccacgaggagcccgtgccgatgtccacgtacggatggaacattgttaaactcatgtcgggtaaggacgtcttctacctgccgcccgaaaagtgtgacaccctactctgcgatatcggcgagtcctccccctctcctaccgtcgaggagagtcgcacgatccgggtgctcaagatggtcgaaccctggcttaagaacaatcagttctgcataaaggttttaaacccctacatgcccacagtaatcgagcatctcgaaaggctgcagcggaagtacggcggtatgctggtgcgcaaccctctctcccgtaacagcacccacgaaatgtactggatttcaaacgggactggcaacatcgtgagctccgtgaacatggtaagtagattactgctgaaccggtttaccatgacgcaccggagacccacaatcgagaaggacgtggacttaggcgccgggacccgccatgtcaatgctgagcctgaaacccccaacatggacgtaatcggcgagcgaatcaagcgcataaaagaagaacactccagcacgtggcactacgacgacgagaacccctacaagacctgggcctaccacggatcctacgaggtgaaagccaccggctctgcgagctccatgataaacggcgtggttaagctgctcacaaagccctgggatgtggtccccatggtgacgcagatggccatgaccgacacaacaccattcggacagcagcgagtgttcaaggagaaagtcgacacgcgcacgccgcgaccaatgccaggcacccgcaaggtgatggagatcaccgccgagtggctgtggcggacacttgggcgcaacaagaagccacgcctctgcaccagagaggaatttacaaagaaggtgcgcaccaatgccgctatgggggcggtcttcaccgaagagaaccagtgggactcagcgcgggccgcagtggaggacgaggagttctggaagctggtggatcgcgagcgggagttgcacaagctgggcaagtgcggttcctgcgtctacaacatgatgggcaagcgcgagaagaagctgggggagttcggaaaagcgaagggcagccgggccatctggtatatgtggctgggggcccgctacctcgagttcgaagcgctaggtttcctaaacgaggaccactggttctcgcgggaaaacagctactccggggtggagggcgagggactccacaagctgggctatattctgcgcgatattagcaaaatccccggcggggctatgtacgcagacgacaccgccggatgggatacccggatcacggaggacgatctacacaacgaggagaagatcacgcaacagatggaccctgagcaccgtcaattggccaacgccatctttaagctgacctaccagaacaaagtggttaaggtgcagcggccaacccctaaggggacagtgatggacatcatctcccgtaaggaccagcggggaagcggccaggtcgggacatacggactcaacacattcaccaacatggaggcccagctggttcgccagatggagggggaaggcgtgttatccaaagcggacctggaaaatccccacctcctggagaagaaaatcacccaatggctcgaaacgaaaggggtcgagcggctgaagcgcatggcaatcagcggtgacgactgtgtggtgaagcccattgatgaccggttcgctaacgccctcctagccctcaacgacatgggtaaggtcaggaaggatatcccgcagtggcaaccgagcaaggggtggcacgattggcagcaggtccccttctgcagccaccacttccatgagctcatcatgaaggatggccggaagctcgtggtcccctgccgcccccaggacgagcttatagggagagcccggatctcccagggcgccggctggtctttaaaggagaccgcctgcttgggcaaggcgtacgcccagatgtggtccctgatgtacttccaccgccgggacttacgtctcgcgagcaacgcgatctgctccgccgtgccggtacactggatccccaccagtcggacaacctggagcatccatgcgcaccatcagtggatgacgaccgaggacatgctgacagtctggaaccgcgtttggatagaggacaacccctggatggaggacaaaaccccagtgacaacctgggaggacatcccgtacctaggcaagcgggaggaccagtggtgtgggtcgttgataggactcacctccagagctacctgggcccagaacatcctaacggccatacagcaagtacggtccctcataggtgacgaggagttcctcgactacatgcccagcatgaaaagattccggaaggaggaggagtccgagggggccatctggtga

SEQ ID NO: 26134 - RNA, 9873 nt, synthetic construct
  misc_feature 1..9873: note = derived and/or modified CDS sequence (opt11) from DENV-3__FJ898456__SS-prME
  source 1..9873: mol_type = other RNA
acaagcctgtgtctaatgatgatgctgccagccaccctggccttccacctgacatcccgggacggcgaacccaggatgatcgtggggaagaacgagcgcggcaagagcctgctgttcaagaccgccagtggtatcaatatgtgcacgctcattgccatggatctgggagagatgtgcgatgacaccgtgacctataagtgtcccttaatcactgaggtggaacccgaggacatcgactgctggtgcaacctcacatctacctgggttacctatgggacctgcaaccaggccggcgagcacaggagagataagcgtagcgtggccctggcgccccacgtgggcatgggactggacacccgcactcagacgtggatgagcgctgaaggcgcctggcggcaggtggagaaggtggagacctgggccttcagacaccccgggttcaccatcctagccctgtttctggcgcactacatcgggacctctttaacgcaaaaggtggtgatcttcatcctgctgatgttagtcacccccagcatgaccatgcggtgcgttggggtgggcaatcgcgacttcgtcgagggcctgtccggtgccacatgggtggacgtggtcctggagcacggcgggtgcgtcacgaccatggccaagaacaagcccaccctcgacatcgagctccaaaagaccgaggccactcaattggcaacactccggaagctttgcatcgagggcaagatcaccaacgtgaccacggacagccgctgccccacccagggtgaggcgatcctgcccgaagaacaggaccagaactacgtctgcaagcacacctacgtggaccgaggctggggcaacgggtgcggtctgttcgggaagggttccctggtgacctgcgccaagttccagtgcttagagagcatcgagggcaaggccgtccaacacgagaaccttaagtacacggtgatcatcaccgtacacacgggggaccaacaccaggtcgggaacgagacccagggggtgactgccgagatcacgccccaggcctccaccgtcgaggcgatcctgcccgaatatggcaccctggggctagagtgctccccccgcaccggtctggactttaatgagatgatactgcttacgatgaaaaacaaagcctggatggtccaccgtcagtggttctttgacctgccgctgccctggaccagcggcgccaccaccgagacgcccacctggaataagaaggagctcctggtgactttcaagaacgcccacgccaagaagcaggaggtcgtggtgctagggagccaggagggcgcaatgcataccgccctcacgggagccaccgagatccaaactagcggcgggaccagcatcttcgcggggcacctgaagtgccgcctgaagatggacaagctcgagctgaagggcatgtcctacgccatgtgcctaaacgcgttcgtcctcaagaaggaggttagcgaaacacaacacggcaccatcctgatcaaagtggagtacaagggcgaggacgccccctgcaagatcccattcagcacagaagacggacagggcaaggcccacaacggacggttaatcaccgccaaccccatcgtcacgaagaaggaggagccagtgaatatagaagcggagcccccgttcggggaatccaatatcgttattgggatcggggataaagccttaaagatcaactggtataagaaaggcagctccatcgggaagatgttcgaagccaccgctcgcggcgcccggcgcatggcgatcctcggcgacacggcgtgggacttcgggagcgtcggcggggtgctgaattccctgggcaagatggtgcaccagatcttcggaagcgcctacacagcgcttttctccggcgttagctggatcatgaagatcggcataggggtgctactgacgtggatcggcctaaactccaagaacaccagcatgtccttcagctgcatcgtcatcggtataatcaccctgtacctgggcgccgtcgtgcaggcggacatgggttgcgtgattaactggaagggcaaggagctcaagtgcggctccggtatattcgtcaccaatgaggtgcacacttggaccgagcagtacaagtttcaggccgacagccccaagcgactggccaccgccatcgccggggcgtgggagaacggggtgtgcggcatccgctccaccacgaggatggagaacctgctctggaagcagatcgccaacgaactgaattacatcctgtgggaaaataatatcaaactcaccatcgtcgtgggggacgtgatcggcatcctcgagcagggcaagcggaccctgacgccacagccaatggagctcaagtactcgtggaagacgtgggggaaggccaagattgtcaccgccgagacccagaattcctccttcatcatcgatggcccgaacacaccagagtgcccctcagcgagccgcgcttggaacgtctgggaggtggaagactacggtttcggggtcttcaccacaaacatctggctgaagcttcgggagatgtacacccagctctgcgaccaccgcctgatgagcgcggccgtgaaggacgagcgggccgttcacgcggacatgggctactggatcgagtcccagaaaaacgggtcttggaagctggagaaggcctccctcatcgaagtcaagacctgcacgtggcccaaatcgcacacgctgtggtcaaacggcgtgctggagagcgacatgatcatcccgaaatccctcgcagggcctattagccagcacaactaccgccccggctaccacacccagaccgccgggccgtggcacctaggcaaactggagctggatttcaactactgcgagggcactacggtggttatcaccgagaactgcggtacgcgggggccctcccttcgcaccacgaccgtgagcgggaagctgatccatgagtggtgctgccggtcctgtaccctgccgcccctccgctatatgggcgaggatggttgttggtacggcatggagatccggccgatcaacgaaaaggaggagaacatggtcaagagcctggtcagcgctggtagcgggaaggcggacaacttcaccatgggcgtgctctgtctggccatcttcttcgaagaggtgatgcgcggtaagtttggcaagaagcacatgatcgccggggccctgttcacgttcgttctcctcctgagtggccagatcacgtggcgggatatggcccacaccctgatcatgatcggcagcaacgcctctgaccgcatgggcatgggcgtgacctacctggccctgattgcgacgttcaagattcagcccttcctcgccctggggttcttcctgcgaaagctcaccagccgcgaaaacctgctgctcggcgtgggcctggctatggccaccaccctgcagctacctgaagacatcgaacagatggccaacggcatcgccctgggcctgatggccctcaagctgatcacgcagttcgagacctaccagctgtggaccgcgctcgtctccctgatgtgcagtaacaccatattcacgctcaccgtggcctggcggacagctaccctcatcctggccgtgatctccctgctcccagtctgccagtccagctccatgcgcaagacggactggttgcctatgaccgtggccgcgatgggggttcccagcctgcccctcttcatcttttccctgaaagacactctgaagcgccgcagctggcccctcaacgaaggcgtcatggccgtaggacttgtttctatcctggccagctccttcttgagaaacgatgtgccaatggccgggcccttagtggccggcgggctgctcatagcttgctacgtaatcaccggcacgagcgccgacttgaccgtggagaaggccgctgacgtgacctgggaagaggaggccgaacagaccggggtctcccacaacctgatgataacggtggacgacgacggcaccatgcggatcaaggatgacgagacagagaacattctgaccgtgctgctgaaaaccgcactcctgatagtctccgggatcttcccctattcgatccccgccacgctgcttgtgtggcacacctggcagaaacagacccagcgcagcggtgtgctgtgggacgtcccgagcccccccgagacccagaaggccgagctggaggagggcgtgtatcggataaagcagcagggcatcttcgggaaaacccaggttggggtaggcgttcagaaggaaggagtattccacaccatgtggcatgtcactcgcggtgcggtgctcacccacaacggcaagcggctggaacctaactgggcgaacgtgaagaaggacctgatttcgtatgggggagggtggaagttatccgcccagtggcagaagggcgaggaggtgcaggttatcgccgtggagccggggaagaaccctaaaagtttccagacgatgcccggaatcttccaaacaaccacgggcgagatcggtgccatcgctctggacttcaagcccggcacctcagggtccccgattatcaaccgcgagggcaaggtcgttggcctgtacgggaacggcgtggtcaccaagaacgggggctatgtaagcgggatcgcgcagaccaacgccgaacccgacggccctaccccggaactggaagaagagatgttcaagaagcgtaacctcacgataatggacctgcaccccggctcggggaagacccgcaaatacctgcctgccatcgtgcgggaggccatcaagaggcggctccgcactctgatcctggcccccacccgggtcgtggccgccgagatggaggaggccctaaaaggcctgccgatcagataccagacgaccgccaccaaatcagagcataccgggcgggagatagtggacttgatgtgccacgccacgttcaccatgcggttgctaagccctgtccgggtgccgaactataacctgattgtgatggacgaggcacacttcaccgacccggcgagtatcgccgcccgcggatacataagcaccagggtcggcatgggcgaggcggccgccatcttcatgacggctactccgcccggcaccgccgacgcattccctcagagcaacgcccccatacaagacgaggagcgcgacataccggagcgttcatggaacagtgggaacgagtggatcaccgactttgccggcaagacggtgtggttcgtgccgtccatcaaggccggcaacgacatcgccaactgcctccgcaagaacggcaagaaggtcatccagctgagccgcaagaccttcaacactgaatatcagaagaccaagctgaacgactgggacttcgtagtaacgaccgacatcagtgaaatgggggcgaacttcaaggccgatcgggtaatagaccctcgcaggtgcctcaagcccgtgatcctgaccgacggcccggagcgcgtgatcctggcgggccccatgcctgttaccgtagccagcgccgcgcagagacgcggccgggtgggccgcaacccccagaaggagaacgaccaatacattttcactgggcagccgttaaataatgacgaggaccatgcccattggaccgaggctaagatgctcctagataacatcaacactcccgagggcattattcccgcgttatttgagcccgagcgggagaagtccgctgcaatagacggggagtaccgcctgaagggcgaaagccggaagacctttgtcgagctgatgcgccggggcgacctcccggtgtggctggcgcacaaggtggcctccgaggggataaaatatactgaccggaagtggtgcttcgacggcgagcggaacaaccagatcctggaggaaaacatggatgtggagatttggacgaaggagggggagaagaaaaagctcagaccccggtggctggacgcgcgcacctattcggaccccctggcgctcaaggagtttaaggacttcgccgccggccgtaagtcaatagccttagacctggtaaccgagattggccgcgtccccagccacctcgcccaccgcaccaggaatgcgctggacaaccttgtgatgcttcacacgagcgagcatgggggcagggcctaccggcacgccgtggaggagctgcctgaaaccatggagaccctgctcctgctgggactgatgatcctgctgaccggcggggccatgctgttcctgatctccggaaaggggatcgggaaaacgagcatcggccttatatgcgtcgtggcctcaagcgggatgctctggatggcggacgtgcccctgcaatggatcgcgtccgccattgtcctggagttcttcatgatggtactccttatcccagaaccagagaagcagcgcacgccccaggacaaccaactggcctacgtggtaattggcatcctaaccctcgctgcgattgttgccgccaacgagatggggttgctcgaaaccacgaagcgggacctgggcatgagcaaggaacccggggtcgtctctcccacctcatacctagatgtagaccttcacccggcctctgcgtggaccctgtacgccgtggccaccactgtcatcactccgatgctgcgccacactatcgagaacagcaccgccaacgtgtccctcgccgcgatcgccaaccaggctgtggtcctgatggggctggacaagggctggcccatctccaagatggacctcggggtgcccctgctggccctcggctgttactcccaagtgaacccgctgaccctgaccgccgcggtactcctgctggtgacccactacgccattatcgggcccgggctccaggccaaggctaccagggaggcgcagaagcgcacggccgccggcatcatgaaaaaccccaccgtggacgggatcatgaccatcgacctggaccccgtcatctacgacagcaagttcgagaagcagctgggccaggttatgctcctggtgctgtgtgccgtccagctcctgctgatgcggacctcttgggccttctgcgaggcactcacgctggccaccgggccgatcacgacactgtgggagggtagccccggcaaattctggaacaccaccatcgctgtgagtatggcaaatatctttcgcgggagctacctcgcaggcgctggtctggccttctcgatcatgaagtccgtaggaacagggaagcggggcactggcagccagggggagacactgggagagaaatggaaaaagaagctcaaccagctgtcacgaaaggagttcgacctgtacaagaaaagtgggatcactgaagtagagcggaccgaggcgaaggagggcctcaagcgcggggagatcacgcaccacgccgtctcccggggcagcgcaaagctccagtggttcgtggaacgcaacatggtgatccccgagggccgggtaatcgacttagggtgcggtcgcgggggctggtcctactactgcgcagggctcaaaaaggtgaccgaggtccggggctataccaagggcgggcccggccacgaagagcccgtgcccatgtcgacatacgggtggaacatcgttaagctgatgtccggcaaggacgtgttctatctgccgcccgagaagtgcgacaccctcttatgcgacatcggggagagctccccgagcccaaccgtggaggagtctcgcacaatccgggtgctgaagatggtcgagccctggctgaaaaataaccagttctgcatcaaggtgctcaatccttatatgccaacagtgatagagcacttagagcgcctgcagcgcaagcacggcggcatgctcgtccggaaccccctgagtcgcaactcaacccacgagatgtactggatcagcaacgggactggcaacatcgtgtccagcgtgaacatggtctcccggcttctcctgaacaggttcacgatgacccaccggcggcccaccatcgaaaaggacgttgatctcggggcaggcacacggcacgtgaacgccgaacccgagacgcccaacatggacgtgatcggcgaacggatccggcgaatcaaggaggagcactcgtccacttggcattatgacgacgagaacccctacaaaacgtgggcctaccacgggagctacgaggtgaaggccaccggcagcgcgtcaagcatgatcaacggggtcgtgaaactcctgacgaagccctgggacgtggtcccgatggttacccagatggccatgaccgatacaacacccttcggccagcaacgggtgttcaaggagaaggtcgacacccgcacgccccggcccatgcccgggacgcgcaaggtgatggagatcacggccgagtggctgtggcggaccctcggccgcaacaagcgccccaggttgtgcacccgtgaggagttcatcaagaaggtgcgcactaacgctgcgatgggcgccgtcttcacggaggagaaccagtgggactccgcccgcgccgccgtggaggacgaggagttctggaagctggtagatagggagcgagaactccacaagttagggaagtgtggtagctgcgtttataacatgatggggaagcgggagaaaaagctgggcgagttcgggaaggcgaagggatcccgagccatctggtacatgtggttgggcgcccggtaccttgagttcgaggccttggggtttctaaacgaggaccactggtttagccgcgagaattcgtatagtggtgttgagggggagggcttacacaagctgggctacatcctccgggacatctccaaaatccccgggggcgccatgtacgcggacgacaccgccgggtgggacacccgcatcaccgaggacgacctgcacaacgaagagaagatcacgcagcagatggaccccgagcacagacgcctggccaacgccatcttcaagctcacataccagaacaaggtggtcaaggtgcagcggccaacccccaagggcaccgttatggacatcatcagccgcaaggaccagagagggtccggccaagtcggaacgtatgggctgaacaccttcaccaacatggaggcgcagctgatccgccagatggagggcgaaggggtcctctcgaaggcggacttagagaacccccacttactcgagaagaaggtgacccaatggctggagaccaagggcgtcgagcggctgaagcgcatggccatctccggtgacgactgtgtggtgaaacccatagacgacaggttcgccaacgccctcctggccctgaacgacatgggcaaagtccgcaaggacattcctcagtggcaacccagcaagggctggcacgactggcagcaggttcccttctgctcccaccacttccacgagctcatcatgaaggacgggcggaagctggtggtcccctgccgcccgcaggacgagctgatcggccgtgcgcgcattagccagggggcgggctggtccctccgcgagacggcctgcctggggaaagcctatgctcagatgtgggccctgatgtacttccatcgccgcgacctccggctcgccagcaacgccatttgttccgccgtgcccgtgcactgggtcccgaccagtcgcaccacctggagcatccacgcccaccaccagtggatgacgaccgaggatatgctgaccgtgtggaaccgggtgtggattgaagacaacccgtggatggaggacaagacaccggttacgacctgggaggacgtgccttacctcggcaagcgcgaggaccagtggtgcggctccttgatcggcctggccagtcgggccacctgggcccagaacatcctcacagccatccagcaggtccgctccctgataggcaacgaggagttcttagattacatgcctagcatgaagcgcttccgcaaagaagaggagtccgagggagcgatctggtga

SEQ ID NO: 26135 - RNA, 9873 nt, synthetic construct
  misc_feature 1..9873: note = derived and/or modified CDS sequence (opt11) from DENV-3__JN697379__SS-prME
  source 1..9873: mol_type = other RNA
acctccctctgtctcatgatgatgctgcccgccactctcgccttccacctcacctcccgagacggcgagccgcggatgatcgtggggaaaaacgaacgcggcaagagccttttattcaaaaccgcgtcagggatcaacatgtgcaccctcatcgccatggacttaggtgagatgtgcgatgataccgtcacgtataaatgcccccatatcaccgaggtggaaccggaggacatcgactgctggtgcaatttgactagcacctgggtgacgtacgggacctgtaaccaggccggcgagcatcggcgcgacaagcggtcagtcgctctagcgccccacgttggcatggggctggataccaggacccagacgtggatgagcgccgagggcgcctggagacaggtggagaaggtcgagacctgggccctccgccatcccgggttcaccatcctcgccctgttcctggctcactacatcggcacctcgctcactcagaaggtggtgatcttcatcctgctgatgttggtcacccctagcatgacgatgcggtgcgttggggtgggtaaccgcgacttcgtggagggactgtccggggcaacttgggtggacgtggtcctcgagcacggcgggtgcgtcacgaccatggccaagaacaaacccaccctcgacatcgaactgcaaaagaccgaagctacgcagctcgcaaccctccggaagctgtgcatcgagggcaaaatcactaacatcaccacggacagccgctgccccacgcagggtgaagcaatcttacccgaggaacaggaccagaactacgtgtgcaaacatacctatgtcgaccggggttggggcaatgggtgcggcctgttcggtaagggctcccttgtgacctgcgccaagttccagtgtcttgagagtatcgagggaaaggtggtccagcacgaaaacctcaagtacacggtgatcatcacagtgcacacgggggaccagcatcaggtcggtaacgagacgcagggcgtgaccgccgagatcacgtcccaggctagcaccgcagaggtaattctgcccgagtacggcaccctgggcctcgagtgctccccacggaccggactggacttcaacgaaatgattctgctcacgatgaagaataaggcgtggatggtgcaccggcaatggttcttcgatctgcccctgccatggaccagcggcgccaccacagagacaccgacttggaaccgcaaggagctcctggtgacctttaagaacgcccacgccaagaagcaagaggtcgtggtgctagggtcccaggagggcgccatgcacaccgcacttacaggcgctaccgagatccagaccagcggcgggacctcgatctttgccggccacctgaaatgccggctgaagatggacaaactcaagctgaagggcatgtcctacgccatgtgcctgaacactttcgttttaaagaaagaggtgtccgaaacgcagcacgggaccatcctgataaaggttgaatacaagggagaggacgccccctgcaagatacccttctccaccgaggacgggcagggaaaggcgcacaacggccgcctgattacagccaacccggtcgtgacgaagaaggaggagcccgtaaacatcgaggccgaaccccctttcggggagagcaacatcgtaatcgggatcggggacaaggccctgaaaatcaactggtacaggaaaggctccagcatcgggaaaatgttcgaggcaaccgctcgtggcgccaggcgcatggccatcttgggcgacaccgcctgggacttcggttccgtaggcggggtgctgaactctctgggcaagatggtgcaccaaatctttgggtctgcgtacacggccctcttctccggcgtgtcctggatcatgaagatcggcatcggggtgctgttaacctggatcgggctcaacagtaagaacacctccatgagcttttcctgcatcgccattggtataatcaccctgtacctcggagtggtcgtgcaagccgacatggggtgcgtcatcaactggaaggggaaggagctcaaatgcggctcgggtatcttcgtgacgaacgaggtgcacacctggaccgagcaatacaaattccaggcagactccccgaagcggctggcgaccgccatcgcgggcgcctgggaaaacggggtgtgcggcatacgaagcacgaccaggatggaaaacctgctctggaagcagatagccaacgagctgaactacatcttgtgggagaacaacattaagctcaccgtggtggtaggtgacattaccggtgtgctggagcaggggaagcggacgctgacaccccagccgatggagctgaagtactcctggaagacatgggggaaggcgaagatagtgaccgccgagacgcaaaacagctccttcattatagacggcccaagcaccccggaatgcccgagcgcctcccgcgcctggaacgtgtgggaggtggaggattatgggttcggcgtgttcaccactaatatctggctaaagctgcgggaggtctacacccagctctgtgaccaccgccttatgtcggcggccgtgaaagacgagcgggccgtgcacgcagacatgggctactggatcgagtcccagaaaaacgggagctggaagttagagaaggcatccctcatcgaagtcaagacgtgtacgtggcccaaatcccacacgctgtggtccaacggggtgcttgagagtgatatgataattcccaagtccctagcggggccgatctcccagcataaccatcgccccggctatcacacccagactgccggcccctggcacttgggcaagctggagctcgatttcaactactgcgaggggaccaccgtggtcatctcggagaactgcggtactcggggcccgagtctgcgtaccaccaccgtgtccgggaagctgatccacgagtggtgctgccgaagctgcacgctaccacccctgcgctacatgggcgaggatgggtgctggtacggcatggaaatccggccaatcaacgaaaaagaggagaatatggtcaagtccctggccagcgcgggctccgggaaagtcgacaacttcacaatgggcgttctctgcctggccatcttatttgaagaagtgatgcgcgggaagtttggcaagaaacacatgatcgctggggtactcttcacgtttgtgctgctgctctctgggcagattacctggcgtgacatggcccacaccctgataatgatcggctcaaacgtgagcgacaggatgggcatgggcgtcacgtacctggccctcatcgcgaccttcaagatccagcccttcctggccctggggttctttctccgaaagctgaccagccgcgaaaatctgctacttggcgtgggcctcgcgatggccgccaccctccggctgcctgaggacatcgagcaaatggccaacgggatcgcattgggcctcatggcgctgaaacttattacgcagttcgagacctaccagctgtggactgccctggtgtctttgacctgcagcaacacgatcttcacactaacggtggcctggcgcacagccaccctgatcctggcggggatctccctcttgcccgtgtgccagtcgtcctctatgcggaagaccgactggctgcctatgaccgtcgccgccatgggcgtgccgccccttcccctgttcatcttctccctgaaggacacccttaagcggcggtcgtggccactgaacgaaggggtgatggccgtcggcctggtcagtatcctggccagctccctgctgcggaacgacgttccgatggcgggccccctcgttgccgggggcttattaatagcctgctacgtcatcactggtaccagcgccgatctaaccgtcgagaaggctgcagacgtaacgtgggaggaagaagccgaacagacgggcgtgtcccacaacctgatgatcacggtggacgatgacgggaccatgcgcataaaagatgacgaaaccgagaacatcctgaccgtcctcttaaagacggcgctgctcatcgtgtctggtatcttcccgtactccatccccgccaccctgctggtgtggcacacctggcaaaagcagacccagagaagcggcgtcctctgggacgttccgagcccacccgagacgcaaaaagctgaactggaggagggcgtgtataggattaagcagcaaggaatattcgggaagacccaggtaggtgtgggggtgcagaaggagggcgtctttcacaccatgtggcacgtaacccggggcgcagtgctgacgcacaacggcaagcggctcgagcccaactgggctagcgtcaagaaggacctgatcagctacggcgggggctggcggctgtccgcccaatggcagaagggggaggaggtacaggtgatcgccgtcgagcccgggaagaaccccaaaaacttccaaactatgccggggatcttccagaccaccacgggggaaatcggcgctatcgcgctggacttcaagcccgggacttccggatcccctatcataaaccgggaggggaaggttgttgggctctacggcaacggggtcgtgaccaagaacggcggttacgtgtccggcatagcccagaccaacgccgaacccgacggacccacgccggaactggaagaggagatgttcaagaaaaggaacctaaccatcatggacctccaccccggctccggcaaaacccgcaagtacctgcctgccatagtccgggaggctatcaagcgccggctgcgcaccctcatcctggcccccacacgggtggtggccgccgagatggaggaggccctgaaaggtttgccaatcaggtaccagaccactgccactaagagcgaacacacgggccgggagatcgtcgacctgatgtgccacgccaccttcacgatgcgcctgctctcacccgtgcgggtgcccaactacaacctaattatcatggacgaggcccacttcaccgacccagccagcatcgccgcgaggggttatatctccacccgcgtgggcatgggcgaggccgctgccatcttcatgaccgctactccgccagggaccgcagacgccttcccccagtccaacgccccaatccaggacgaagaacgggacataccggagcgctcatggaacagcggcaacgagtggataacggacttcgtcggaaagaccgtgtggttcgtcccatccatcaaagccggcaacgacatcgcgaattgccttcggaagaacgggaaaaaggtgatccagctatcaagaaaaactttcgacaccgagtatcagaagacgaagctgaacgactgggactttgtggtgaccaccgacatctccgagatgggcgccaatttcaaggccgaccgggttatcgacccccgtcggtgcttgaagccagttatcctcaccgacggcccagagcgcgtcatcttggcagggccaatgcctgtgactgtggccagcgcggcccagcggaggggccgagtcggtcgcaacccacagaaggagaacgaccaatacatcttcatgggtcagccgctgaacaacgacgaggaccacgcccactggaccgaggccaagatgctcctggacaacatcaacacccccgagggaatcatccccgccctgtttgagcccgagcgcgagaaatccgcagcaatagacggcgaataccgcctcaagggagagagccggaagaccttcgtggagctgatgcgccggggcgacctgccggtctggctcgcccataaagtggccagcgagggtatcaagtacaccgaccgcaagtggtgcttcgatggggagcggaacaaccaaatcctggaggagaacatggacgtggagatctggactaaagaaggcgagaagaagaagctccgcccgcgctggctcgacgcgcggacctatagcgaccccctggccctgaaggagttcaaggacttcgcggccgggcggaaaagcatcgccctcgacctcgttaccgagattgggcgggtcccctcccaccttgcccaccgcacccggaacgctctcgacaacctggtgatgctgcacacgagcgagcacggcgggcgcgcctataggcacgccgtagaggaactcccggagaccatggagacactgctgctcctgggcctgatgatcctcctgaccgggggcgcgatgctttttctgatctccggcaaagggatcggcaagacgtctatcggtctgatctgcgttatcgcgtccagcggcatgctgtggatggccgacgttccactccagtggatcgcctctgccatcgtactggagttcttcatgatggtgctgctcatccccgagcctgagaagcagcgcaccccacaggacaaccagctggcctatgtggtaatcgggatcctgaccctcgcggccatcgtggccgctaacgagatgggcctgctggagactacgaagcgggacctcggcatgagcaaggaacccggggtggtttcccctacgagctacctggacgtggaccttcaccccgccagcgcgtggacgctatacgcagttgccaccacagtcatcacgcccatgctgcgccataccatagagaactcgacagccaacgtgtccctggcggccatcgccaatcaggccgtggtcctcatgggcctggataaggggtggcccatcagcaagatggacctgggcgtgcctctcctggctttagggtgctactcccaggtgaacccgctgacgctggcggccgcggtcttactcctggtgacgcattacgctatcatcggccccgggctgcaggccaaagcaacgcgggaggcccagaagcgcaccgccgcagggattatgaagaaccccactgtagatggcatcatgaccatcgacctcgaccccgtaatctatgatagtaagttcgagaaacagttaggacaggtcatgctgctcgtgctgtgcgccgtacaattactactgatgcggacctcctgggcgctgtgtgaagtgctcactctggcaacgggcccgataactaccctgtgggagggcagccccgggaagttttggaacaccacaatcgccgtatccatggccaacattttccgcggcagctacctagcgggggcgggactggccttcagcatcatgaagtcagtagggaccggtaagcggggcacaggcagccagggcgagaccctgggggagaagtggaagaaaaagctcaaccaacttagccgcaaggaatttgacctatataagaaaagcggcatcaccgaggtggaccggaccgaagccaaggagggactcaaacgcggcgagatcacccatcacgccgtttcccggggttcagcgaagctgcagtggttcgtcgagcgcaacatggtgatccccgaggggcgggtgatcgacctcggatgtggtcgcggagggtggagctactactgcgcaggactcaagaaggtcacagaagtgcgcggctacacaaaagggggccccggtcacgaggagccggtacccatgagcacgtacggctggaacatcgtcaagctgatgtccgggaaggacgtgttttatcttccacccgagaagtgcgacaccctgctctgcgacatcggcgagagctccccgagccctaccgtggaggagtcccggaccatccgcgtcctgaagatggtggagccctggctgaagaacaatcagttctgcatcaaagttctcaatccctacatgccgacggtgatcgagcacctggagcggctgcagcgtaaacatggcggcatgctcgtgcgaaacccgctgtcacgcaactccacccacgagatgtactggatctccaacggcacggggaatatcgtgtccagcgtcaacatggtgtcccggctgctcctgaacagattcactatgacccaccggcgacccaccatcgagaaagacgtggaccttggcgccggcacccggcatgtgaacgctgagcccgagacccctaatatggacgtcatcggggaacgcatcaagcggatcaaggaggagcacagcagcacgtggcactacgacgacgagaacccctataagacatgggcttaccacggctcttacgaggtcaaggcgactggcagcgcctcaagcatgattaacggcgttgtaaaactcctgacgaagccgtgggatgtcgtgcccatggtgactcagatggccatgaccgacaccaccccgtttgggcagcagcgagtcttcaaggaaaaggtggacacgcggactccccggcctatgcccgggacccggaaggtgatggaaatcacggccgagtggctgtggcgcacgctcgggcggaataagcgcccccgcctgtgcacccgggaggagttcacaaagaaggtgaggaccaacgccgcgatgggggccgtcttcactgaggagaaccagtgggactccgctcgggccgcggtggaagacgaagagttctggaagctggtcgaccgcgagcgggagttgcacaaactgggcaaatgcggaagctgtgtgtacaacatgatgggcaagcgcgagaaaaagctgggcgagttcggaaaggccaaaggatcccgagctatttggtacatgtggctcggagcccgttacttggagttcgaggccctgggattcctaaatgaggaccactggttttcacgggaaaattcctattctggggttgagggcgaagggctgcataaactgggctacatactccgtgacatctcgaagattcccggcggggcgatgtatgccgacgacactgcaggttgggacacccggattaccgaggacgatttacacaatgaagagaagatcacgcaacagatggaccccgagcaccgccagctggccaatgctatcttcaagctcacctaccagaacaaagtcgtgaaggtgcagcggccaacccccaagggaaccgttatggacatcatcagccgcaaggaccagcggggctccggccaggtagggacgtacggtctgaacacattcaccaacatggaagcgcagcttatccgccagatggagggggagggggtgctcagcaaggctgacttagaaaacccccatcccctggaaaagaagattacccagtggctagagactaaaggggttgagagactgaagcgcatggccatctccggcgacgactgcgtcgtcaagcctatcgacgatcggttcgcaaacgcgctgctcgcgctaaacgatatggggaaagttagaaaggacatcccccagtggcaaccctccaagggctggcatgactggcaacaggtgcctttctgttcacatcatttccacgagctgatcatgaaggacggccggaagctcgtggttccgtgccgcccccaggacgaattaatcgggcgcgcccgaataagccagggcgccggttggtccctgcgcgagacggcctgcctcggcaaggcatacgcgcagatgtggaccctgatgtactttcaccggcgcgacctgcggcttgcctctaacgccatatgcagcgccgtgccggtgcattgggtccccacatcccgtaccacgtggtcgatccatgcccaccaccagtggatgaccaccgaggacatgctcaccgtgtggaaccgggtctggatcgaggacaacccctggatggaggacaagacgccagtcactacgtgggaggacgtgccctacctcggaaagagggaagaccaatggtgtggttcgctcatcggcttaacaagccgggcaacttgggcccagaacattctgaccgccatccaacaggtccgttccctcatcggcaacgaggagttcttggattacatgccgtcgatgaagaggttccgcaaggaggaggagtcagagggcgccatctggtga

SEQ ID NO: 26136 - RNA, 9873 nt, synthetic construct
  misc_feature 1..9873: note = derived and/or modified CDS sequence (opt11) from DENV-3__JQ045687__SS-prME
  source 1..9873: mol_type = other RNA
accagcctctgcctgatgatgatgctaccggcaacccttgcatttcacctaacaagcagagacggggaacccaggatgatcgtcgggaaaaatgaacggggaaaaagccttctcttcaaaaccgcatcaggaataaatatgtgtacactcattgcaatggatctaggagaaatgtgtgacgacacggtaacgtacaaatgccccctggtagcggaagtagaaccggaagacatcgactgttggtgtaatctcacgtccacatgggttacctacggcacatgcaaccaggctggagaacataggcgcgacaaacgaagcgtggcattagcaccccacgtgggaatgggcttggacacccggacgcaaacgtggatgtcagcagaaggcgcgtggcgccaggtcgaaaaagtagaaacatgggcattgagacacccaggcttcactatacttgccttattcctagcgcattacatcggaacgtcgctgacccaaaaagtggtcattttcatccttctcatgctggttacgccctccatgacgatgcgttgcgtgggtgtaggaaaccgcgacttcgtagaaggtctctctggggccacgtgggtggatgttgtgctggaacacggcggttgcgtaacaacaatggccaaaaacaaaccaaccctcgatatcgaactacagaaaaccgaagctacacaacttgcgacgttaaggaaattatgcatagaaggaaaaataacgaatattacgacggatagccgctgccccacccaaggcgaagcgatactcccggaagaacaggaccaaaattatgtatgcaaacatacatacgtggatagaggatggggaaacggatgcggcttgttcggaaagggatcgcttgtgacctgcgcgaaattccaatgtctcgagccgattgaaggaaaagtcgtacagtatgaaaacctcaagtacaccgtgatcatcacagtgcatacgggagatcaacatcaggtgggcaacgacacacagggagtcacagtcgagataaccccacaggcatcaacggtggaggcggtcctcccagagtacgggaccctagggctcgaatgcagtccccggacagggctggacttcaatgagatgatactcctcactatgaaaaacaaggcctggatggtacaccggcagtggttctttgacctaccactaccatggacctcaggtgcaaccacagaaaccccgacttggaacaagaaagaactcttagtgactttcaaaaatgctcacgccaagaaacaagaagtggtcgtcctgggctcgcaagaaggagcaatgcacacagccttaaccggagccacagagatacaaaacagcggcggcacgtcaatttttgccggccacttaaaatgccgtttgaaaatggacaaactagagctaaaaggcatgagctacgcgatgtgcctaaacacattcgtgctcaagaaagaagtttcagaaacacaacacggcacaatcctgataaaagttgaatacaaaggcgaggacgccccttgcaaaataccttttagtacggaagacgggcaagggaaggctcataacgggcgcctcattaccgccaatccagtcgtcacgaagaaagaagaaccagtaaacatagaagcagaacctccattcggcgagagcaacattgtaattgggataggagacaaggccctaaaaataaactggtataagaaaggcagttctataggaaaaatgttcgaagccaccgcgcggggtgcacggcggatggcgatcctgggagataccgcttgggactttgggtccgtcgggggagtactaaacagcctcgggaaaatggtgcatcagatattcggatccgcgtatacggccctattttcaggtgtatcctggataatgaaaataggaatcggagtgcttctcacctggattggcctaaattcaaagaacacgagcatgtcattcagttgcatcgtcataggcatcataacactatacttgggggccgtagtacaagcggatatgggttgcgcaatcaactggaagggcaaagaactcaaatgtgggagcggaatcttcgtcacaaatgaagtacacacttggaccgaacaatacaaattccaagcggatagtccgaaacgattagccacggccatcgcgggtgcatgggaaaacggtgtatgcgggatacggagcaccacgcggatggagaacctactgtggaaacagatagcaaacgaattgaactacatcttatgggaaaacaatatcaaactaaccgtggtggtaggagacattatcggcgtacttgagcaaggtaaacggactctaaccccacaaccgatggagctgaagtactcatggaagacttggggcaaggccaagattgtaaccgcggaaacacaaaactcatcattcataatagatggtcccaacactccggaatgtccatctgcgagcagggcctggaacgtgtgggaggtagaagactacggattcggagttttcactaccaacatctggctaaaactgcgtgaagtctacacccaaagctgcgatcacaggctcatgagcgcagcaatcaaagacgagagagctgtacacgcggacatgggctactggattgaaagccaaaagaacggatcctggaagctggaaaaggctagtttcatagaagttaagacatgcacttggccgaaaagccacacgctatggagtaacggagtactcgaaagcgatatgataatcccgaaaagcctagcaggaccaattagccaacacaaccaccgtcccggatatcacacccaaacggcagggccatggcatttgggaaagctagaactcgatttcaactactgcgaaggcaccacagtagtcataacagagaactgcggaacgagaggaccaagccttagaacgacaactgtcagcgggaagctcattcatgaatggtgttgtcggtcgtgcaccctacccccgctaagatacatgggggaagacggatgttggtacggcatggaaatcagaccgatcaacgagaaagaagaaaacatggtaaagagcttagtaagcgccgggtcggggaaggtcgacaactttactatgggagtactctgtctcgccattctgtttgaggaagtcatgcggggaaagttcgggaagaaacacatgatagccggtgtactattcactttcgtccttctcctcagcggacaaataacatggcgggatatggcacataccctgatcatgatcggttcaaacgcgtcggaccgcatggggatgggcgtaacctacttagcgttgatcgcaacgtttaagatacaacctttcctggctctcggatttttcctacgaaaattaacaagcagagaaaacctcctactgggtgtcggtttagccatggcaacgacactccagctacccgaggacatagaacagatggccaacgggatcgccctaggactcatgaccctcaaactgataacacagttcgaaacctaccagctctggaccgcgctagtatcgcttacatgttccaacacgatattcaccctgaccgtcgcatggagaaccgccacactcatcttagccggagtgtcgctgctaccactctgtcagtcaagttccatgcgtaagacagactggttacctatgactgtcgccgcaatgggggtcccaccgttacctctttttattttctcactaaaagacacgcctaagcgacgctcatggccactgaacgagggtgtaatggccgttgggctagtgtcaatactagctagttctcttctgcgtaacgatgttccaatggccgggcctctggtggcaggcggtctcctaatcgcttgctacgtgattaccgggaccagcgccgacctcacggtcgaaaaagccgcagatgtaacctgggaagaagaggccgaacagacaggcgttagccataacctcatgatcaccgtcgacgatgacggtactatgcgcatcaaagatgacgaaaccgagaacatcctcacagtcctactcaaaacggcccttctaattgtcagcggtatcttcccctacagcatcccagctacgctgctagtttggcacacctggcaaaagcaaacgcaaaggtcaggagtcctatgggacgtaccttcgccaccggaaacacaaaaggccgagctggaggaaggagtatatcggataaaacaacaaggaatcttcggaaaaacccaagttggtgtaggagtacaaaaagaaggagtcttccacacaatgtggcacgtaactcgaggagccgtcctgacacacaacggtaaaagactggagcccaactgggcgtccgtaaagaaagaccttataagttacggcggagggtggcgtctttccgcccagtggcaaaagggcgaagaggtacaggttatagctgtcgaaccaggcaaaaatcccaaaaacttccaaacaatgcccggaatatttcaaacgactacgggcgaaataggcgcgatagcactagacttcaaacccggaaccagtggaagtccgatcataaaccgggaaggcaaggtagtaggactctatggcaatggcgtggtaacgaaaaacggtgggtacgtcagtggcatagcccaaacaaatgcagaaccagatggaccaacacccgagttagaagaagagatgttcaaaaagcgtaacctaaccaccatggacctgcatccgggcagcggaaaaacacgcaagtatttacccgccatagtcagagaagcaatcaaacgtagactacggaccctaatcctcgcaccaacgagggtggtcgctgcggaaatggaggaggccctcaaaggattaccgattcgatatcagacgacggccacaaagagtgagcacacaggtcgcgagatcgtggacctgatgtgtcacgcaaccttcaccatgcgactgctctcccccgtacgagtgcctaattataacctaataataatggacgaagcccatttcacagatccagcgagcatagctgccagaggctacatctcaaccagagtcggcatgggagaagccgccgccatcttcatgacagcgacccctcccgggactgccgaagcattcccgcagagcaacgcgccgatacaggacgaagagagggacataccagagaggtcatggaactccggtaacgaatggatcacagactttgtggggaagacagtatggttcgtcccaagtataaaggcggggaatgacatcgcaaattgcctccggaaaaacggaaagaaggttattcaactctcgagaaagaccttcgacacagaataccagaaaaccagactaaatgattgggactttgtagtcacgaccgacatttctgagatgggtgcgaactttaaagcagaccgcgtcattgatccgcggaggtgcctaaagcccgtaatactcacggacggccccgagcgggtcatcttggccggccctatgccagtcacggcagcaagcgcagcacagcgccgcggccgcgtcggccggaacccccaaaaagaaaacgatcaatacatctttactggacaaccactaaacaacgatgaagaccatgcgcattggacggaggcaaagatgctactggacaacatcaacacaccggaagggatcatcccggcgttattcgagcccgaacgagaaaagagcgcggcgatcgatggcgagtaccgactcaaaggcgaaagcagaaaaacttttgtggagttaatgaggcgcggggacctaccagtatggctggcgcacaaggtggcgtccgagggcatcaaatacactgacagaaaatggtgctttgacggggaaagaaataaccagatactggaagagaatatggatgtggaaatttggacaaaagaaggcgaaagaaagaaattgcgcccccgttggctggatgcccgaacttacagcgatccacttgcacttaaagagttcaaggatttcgcagcaggaaggaaatcaatcgccctggatctcgtaactgaaattgggcgcgtacctagtcacttggcctaccgcacacgcaatgctctagataacctcgttatgctccatacaagcgaacatggcggacgagcttatcgacacgccgttgaagaactaccggaaaccatggagacattactacttctaggattaatgatcttgctgacaggcggagcaatgctgttcttaatatcaggaaaaggcatagggaagacgtcaattgggctgatatgtgttatagtctctagcgggatgttgtggatggctgacgtccctctacaatggatcgcgtccgcaatagtgctggagttctttatgatggttttgctcattccagaaccagaaaaacaaagaacaccccaggataaccagctagcgtacgtagttatcggcattctgacactcgcggcaatcgtggcggcgaatgaaatgggattgttggaaacaacgaagagggatctcggcatgtcgaaagaaccgggcgtagtcagcccgaccagttacctagacgttgacctgcacccagcaagcgcctggacgttgtacgccgttgccacgacggtcatcaccccaatgctaagacataccatcgagaactcgacggccaacgtaagtctcgctgccatagctaaccaggcagtcgtactgatgggactagacaaagggtggccgatctcgaaaatggacctcggagtaccactcctggcattgggatgctattcacaagtaaaccctttaacccttacggccgccgtcctcctgctcgtcactcattacgctatcattggtcccggcctgcaagcgaaagcaacacgagaggcacagaagcgaacggccgcaggcataatgaagaatccgaccgtagacggaatcatgacgatagacctcgaccccgtgatttacgactccaagttcgagaaacagctcgggcaagttatgctcctagtgctctgcgccgtccaattgctactgatgaggacctcgtgggcgctctgtgaggcgctcacccttgccaccgggcctataacaaccctctgggaagggtcgcccggaaagttctggaacacgacgatcgcagtcagcatggcgaacatattcaggggctcatacctagcgggcgcggggctagcattcagcattatgaaaagcgtagggaccggccgacgtggcaccggctcccagggagaaaccctaggagagaaatggaagaagaaattaaaccaactaagccgcaaggagttcgacctctacaaaaagtctggcataaccgaggtcgatagaacagaggcaaaggagggacttaaaagaggagagaccacacaccatgcagtgtccagaggatccgccaaattacaatggttcgtcgaacgtaacatggtaatccctgaggggagggtgatagacttaggctgcggacgcggcggctggtcctactactgcgctggcctcaaaaaggtgacagaggtgaggggttacacaaaaggcgggcccgggcacgaagaacctgtcccaatgtccacctacggctggaacattgtgaaacttatgagtggcaaggacgttttctatctaccccctgaaaagtgcgacacgttactctgcgatataggcgaaagtagtccgtcccccacggtagaagagtccagaacaattagagtattgaaaatggtcgagccatggctcaagaataaccagttctgcatcaaagtgctaaacccttacatgcccacggtaatagaacaccttgaacgcctacaacgcaagtatggaggaatgctggtacgaaacccattgtctcgcaatagtacccatgaaatgtactggatcagcaacggaaccggcaacatagtaagtagcgtcaacatggtcagtcgactactgcttaacagattcacaatgacgcatcgacgaccgactatcgaaaaagatgtggacctcggggcgggcaccagacacgtgaacgccgaaccagaaacgcctaacatggacgtcataggcgagagaataaagagaataaaggaggagcacagcagtacctggcactacgacgacgaaaatccgtacaaaacgtgggcctaccacgggagttacgaagtcaaagccacaggatccgcctcctccatgataaacggtgtcgtgaagctgttgacaaaaccatgggatgtagtccccatggtgacgcaaatggcaatgacagacacaacaccattcggccagcaacgcgttttcaaggaaaaagtagacaccagaaccccacgaccgatgccaggaacgcgcaaagttatggaaatcacagcagaatggctctggcgaacgcttggccgaaacaagaagcccagattgtgcacccgcgaagagttcaccaagaaagtaaggaccaatgctgctatgggcgcagtgttcaccgaagagaaccaatgggacagcgcgcgggcagccgtagaagacgaggagttctggaagttagtagatcgtgaaagggagctacacaagctgggcaaatgcggatcctgcgtgtataacatgatgggaaagcgggaaaagaaactaggggagttcgggaaagcgaaaggatcacgggcaatatggtacatgtggctgggggcccgctacctcgagttcgaggccctggggttcctaaacgaggatcactggttcagccgagaaaatagctacagcggcgttgagggtgagggccttcacaagctaggttacatactccgagacatcagcaaaataccgggtggtgcgatgtacgcagacgataccgccggctgggatacgcgcatcacagaagacgatttacacaacgaagagaaaattacgcaacaaatggaccccgagcatcggcagctagcaaacgcaatctttaaattaacgtaccagaacaaagtcgtgaaagtacaaaggcccacaccgaagggaactgttatggacataatctcgagaaaggatcaacggggcagcgggcaagtaggcacgtatggactcaataccttcactaacatggaggcacagctcgtacgccaaatggaaggtgaaggcgtgctaagcaaggccgacctagagaacccacatctgctcgagaaaaagattacccagtggctcgagacaaagggagtagaacgactgaaacgaatggcaattagcggcgacgactgcgtggtaaaaccaatcgacgaccggtttgcaaacgcattattagccctcaacgacatgggtaaagtgcgaaaggacataccgcaatggcaaccatcgaaaggctggcacgactggcagcaagtacccttctgtagtcatcattttcatgaacttatcatgaaagacgggaggaagctagtcgtaccctgccgtccgcaggacgaactgataggcagagcacggatatcgcagggggctggctggagtctcaaggagaccgcttgcctcggaaaagcctacgcccagatgtggtccctgatgtacttccatcggcgcgatctgcgactcgcgagtaacgcaatctgcagcgcagtcccggtccactggatcccgacgtccaggaccacatggagtatacacgcccatcaccagtggatgacgacggaagacatgctgacagtttggaaccgtgtctggatcgaagacaatccatggatggaggataaaacaccggtaacaacatgggaagacgtcccatacctcggcaagcgcgaagaccaatggtgcggtagtctaattggactaacatcgcgcgccacctgggcacaaaacatattgaccgctatccaacaagtgcggagtttgatcggagatgaagagttcctggattacatgccctccatgaagcgattcaggaaagaagaggagagcgaaggcgccatctggtga

SEQ ID NO: 26137 - RNA, 9873 nt, synthetic construct
  misc_feature 1..9873: note = derived and/or modified CDS sequence (opt11) from DENV-3__JQ045689__SS-prME
  source 1..9873: mol_type = other RNA
accagtctgtgtctcatgatgatgctgcccgcgactttggctttccatctcaccagccgggacggcgaaccgagaatgatcgttgggaagaacgagcgcggaaaaagcctgctgttcaagaccgcgtccgggatcaatatgtgcactctcatcgcgatggacctgggcgagatgtgcgacgacaccgtcacctacaagtgccccctgatcgccgaggtggagcccgaggacatcgactgctggtgcaacctcaccagcacctgggtgacctacgggacatgcaaccaggccggcgagcaccggcgtgacaagcggtccgtagccctggcgccccacgttggcatgggactggatacccgcacgcagacctggatgagcgccgagggcgcctggcggcaattcgagaaggtcgagacgtgggctctccgccacccggggttcaccatattagcgctgtttctagcccactacatcggtacgtcactgacacagaaggtcgtgatcttcatcctactcatgctagtaacgccctcaatgaccatgcggtgtgtaggggtcggcaaccgcgacttcgtggaaggcctgtccggggccacctgggtcgacgtagtgctcgaacacggcgggtgcgtcaccacgatggccaagaacaagcccaccctcgacatcgaactgcagaaaaccgaggccactcagcttgcgactctccggaagctatgcatcgagggcaagatcaccaacatcaccaccgacagccgctgccccacgcagggcgaggccatcttaccggaggagcaggaccagaactacgtgtgtaagcacacctatgtggaccgggggtggggcaacgggtgcggcctgttcgggaagggctccctggtgacctgtgccaagtttcagtgcctcgagcccatcgagggaaaggtggttcagtacgaaaacctgaaatacaccgtcatcattacggtgcacactggggaccagcaccaggtcgggaacgacacccaaggggtgacggtggagatcacgccccaggcaagcaccgttgaggctgtgttgccagagtacggcaccctcgggctcgagtgttccccgcgcaccggcctggacttcaacgagatgatcctcctcaccatgaagaacaaggcgtggatggtgcataggcagtggttcttcgacctgcccttgccttggacaagcggcgccaccaccgagacccccacgtggaaccgcaaggagctgctggtcaccttcaagaatgcccacgccaagaagcaagaggtggtggtcttggggagtcaggagggtgccatgcacaccgcgctgaccggcgccacagagatccagaacagcggcggaacctccatcttcgccggccatctgaagtgccggctaaagatggacaagctggagttgaagggcatgtcgtacgccatgtgcttgaacaccttcgttctgaagaaggaggtgtccgaaacccaacacgggacgatcctgatcaaggtggagtacaaaggcgaagacgccccgtgcaagatccctttcagcaccgaggacggacaaggtaaagcacacaatggacgcctgattaccgcgaaccccgtggtgaccaagaaggaggagcccgtcaacatcgaagcggagccacccttcggggagtcaaacatcgtgattggcatcggcgataaggccctcaagatcaactggtacaagaagggttccagcatcggtaagatgttcgaggccacggcccggggcgccaggcggatggccatcctgggcgataccgcctgggacttcggctccgtgggcggggtcctgaacagcctcgggaagatggtccaccagatcttcgggtccgcttacaccgccttattcagcggcgtctcctggatcatgaagatcgggattggcgtactactcacttggatcggcctgaatagcaaaaatacgtccatgagcttttcctgcatcgtgatcgggatcatcacactgtacctcggcgccgtagttcaggccgacatgggttgcgcaatcaactggaaaggaaaggagttaaagtgcggcagcgggatcttcgtgaccaacgaggtgcacacgtggactgagcagtacaagttccaagcagacagccccaaacgccttgctacggccatagccggagcctgggaaaatggggtctgcggcatccgtagcacgaccagaatggagaacctcctgtggaagcagatcgcgaacgaactgaactatatcctctgggagaacaacatcaagctgactgtggtggtcggcgacattatcggcgtgctcgagcagggcaagcgcaccctcaccccgcagccgatggagttgaagtactcctggaagacctgggggaaggccaagatcgtgacggccgaaacccagaacagctccttcatcatcgacgggcccaacacccccgagtgccccagcgcctcgcgggcgtggaacgtctgggaagtagaggactacgggtttggcgtgttcaccacgaacatctggttaaagctccgcgaagtctacacccagtcctgcgaccaccggttaatgtctgccgcgatcaaggacgaacgcgctgtgcacgccgacatgggctactggatcgagtcccagaagaacgggagctggaagctggagaaggcttccttcattgaggtgaaaacctgcacctggcccaagagccacaccctctggtccaacggcgtcctggaatcggacatgatcatcccaaaatcgcttgccggtcccatcagccagcataaccaccggcctggctaccacacgcagaccgccgggccatggcatctgggcaagctggagctggacttcaactactgcgaaggcaccaccgtggtgatcacggagaactgcgggacccgtggcccctccctccggaccaccactgtctctggtaagctgatccacgaatggtgctgtcgctcctgcacactgcccccgctccggtacatgggcgaggacgggtgctggtacggcatggagattcgccccatcaacgagaaggaggagaatatggtcaaaagcctggtatccgccgggagcggcaaggtcgacaacttcaccatgggcgtgttatgcttggctatccttttcgaagaggtgatgcgcgggaagttcggcaagaagcatatgatcgccggggtactcttcaccttcgtactccttttgtccggccaaatcacctggcgcgatatggcccacactctcatcatgatcggctccaacgccagcgaccggatggggatgggagtgacctacctggcgctgatcgccacctttaagatccaacccttcttagcgctggggtttttcctgcgcaagctcacgagccgggagaacctgctgttgggcgtcggcctggcgatggcgaccaccctgcagctccccgaagacattgagcagatggcgaacgggatcgcgctgggccttatgacccttaaactgatcacgcagttcgagacctaccagctgtggaccgccctcgtttcactcacgtgctcaaatactatattcaccctgaccgtggcctggcgaacggccacgctcatactggctggggtcagcctgctcccgctgtgccagtcctcctccatgcggaagaccgactggctgcccatgaccgtggcggccatgggcgtaccgcccctgccgctgtttatcttcagccttaaggacacgcccaagcgccgctcctggcccctcaacgagggggtaatggccgtgggcctggttagcatccttgcatctagcctcctgagaaatgacgtgcccatggccggcccgctggtggcaggcgggctcctgatcgcctgctacgtcatcacgggaacctccgcagacctgaccgtggagaaagcagccgacgtgacctgggaggaggaagcggaacaaacgggggtcagccataacctcatgatcaccgtggatgacgacggaaccatgcgtatcaaggacgacgagaccgaaaacattctgaccgtactgctcaagacagccctcctgattgtctccggcatcttcccttatagcatcccggccaccctccttgtgtggcacacctggcaaaaacagactcagcggtccggcgtgctatgggacgtaccttcgccgcccgagacgcaaaaagccgagctcgaggagggagtgtaccgcatcaagcaacagggcatctttggaaagacccaggtaggcgtgggggtgcagaaggaaggcgtattccacaccatgtggcacgtcacccgaggcgccgtgctaacgcacaatgggaagcgcctggagcctaactgggcgtccgtgaaaaaggatctcatatcctacggcggcggctggcggctgtccgcccagtggcagaagggggaggaggtccaggtgatcgccgtggagcctggcaagaaccccaagaacttccagaccatgcccgggatattccagacaaccacgggggagatcggcgccatcgcgctggatttcaagcccgggacaagtgggagccctataataaatcgcgagggcaaggtcgtggggttgtacggcaacggggtcgtcaccaagaacggtgggtatgtgtccggtatcgcgcagaccaacgccgagcccgacggcccgacacccgaattagaggaggaaatgttcaagaagcgcaatctgaccatcatggatctgcacccggggagcggcaagacccgcaagtacctccccgccatcgtgagagaggcaataaagcgtcggctgcgcaccctgatccttgcgcctacgcgggtcgtggcggcagagatggaggaggccctgaaggggctccccatccgctaccagaccaccgccaccaagtccgagcacacgggccgggagatcgtggacctcatgtgccatgcgacctttaccatgcggctgctgagcccggttcgggtgcctaactacaacctcatcatcatggacgaggcccacttcaccgaccccgcctccatcgccgccagaggatacatcagtacgcgggtgggcatgggcgaggcggccgccatcttcatgacggccaccccgcccgggaccgcagaggccttcccccaatccaacgcaccaatccaggacgaggagcgcgatattcccgagcgcagctggaactccggaaatgagtggataactgacttcgtcgggaagaccgtgtggttcgtgccctccatcaaggccggcaacgacatcgctaactgcctgcggaagaacgggaaaaaggttatccagctgtcccgcaagaccttcgacacggagtaccagaagacgaggctaaacgactgggacttcgtggtgaccaccgacatcagcgagatgggcgccaacttcaaggctgaccgggtcatcgacccccggcgctgcctgaagccggtgattctgaccgacggacccgagcgggttattctcgccgggccgatgcccgtgacggcagcctctgcggcacaacgccggggacgcgttgggcgcaacccccaaaaagagaacgaccaatacatcttcaccggccagcccctgaacaacgacgaggaccacgcccactggaccgaggccaagatgctgctcgacaacataaatacacccgaggggatcattcccgcgctgttcgagcccgagcgcgaaaagtcggcggcgatcgacggcgaataccggctgaagggcgagtcccgcaagaccttcgtggaactcatgcggcgcggggacctgccggtctggctggcgcacaaggtggccagcgagggcatcaaatacacggatcggaaatggtgcttcgatggggagcgcaacaaccagatcctcgaagagaacatggacgtcgagatctggaccaaggagggcgagcgaaagaaactgcgcccgcgctggctggacgcgcgcacctattctgaccccctcgccctgaaagagtttaaagatttcgcggccggccgcaaaagcatcgccctggacctcgtgaccgagatcgggcgggtgccctcgcacttggcgcatcgcacgcggaacgccctagataacctcgtcatgctgcacaccagcgagcacggcgggcgagcctaccggcacgccgtggaggagctgccggagaccatggagacgctcctgctgctcggcctgatgatcttgctcaccgggggcgcaatgctgttcctgatcagcggcaaggggatcggcaagacatccatcgggttaatctgtgtcatcgtgagctccggcatgctatggatggcggacgtgcccctgcagtggatcgccagcgccatcgtgctcgagttcttcatgatggtactcttgatccctgagcccgagaagcagcgcaccccgcaggacaaccagctagcctacgtggtgattgggatcctcaccctggcggcgattgttgccgctaacgagatgggcttgctcgagacgaccaaacgagacctaggcatgtccaaagaacccggagtggtgtcgccaacctcctacctcgacgtcgacctgcaccccgccagcgcgtggaccttgtatgcggtcgccactaccgtgatcactccgatgttacgccacaccattgagaactccacggccaacgtcagcctggccgcgatcgctaaccaggccgtggtgctgatgggcctcgacaaggggtggcccatctctaagatggacttaggcgtcccgctgctcgccttggggtgctacagccaggtgaacccgctaaccctcactgctgcggtgcttttactcgtgacccactatgctataatagggccgggcttgcaagcaaaggcgacccgggaggcccagaagcgcaccgcggccgggatcatgaagaaccccaccgtggatggcattatgactatcgacctggaccccgtgatctacgactccaagttcgagaagcagctcgggcaggtcatgctgctggtgctctgcgcggtgcaacttcttctcatgcggacgagctgggccctgtgcgaggccctgaccctcgcaaccggccccatcaccactctgtgggagggatcaccggggaaattctggaacaccaccatcgcggtaagcatggccaacatcttccgcggttcctacctagccggagcgggcctcgccttcagcatcatgaagtccgtagggaccggccggcgcggcacggggagccaaggagagaccctgggagagaagtggaagaagaagctgaatcagttgagccggaaggagttcgacctgtacaagaagagtggaattaccgaggtggatcgcaccgaggccaaggaggggctgaaaaggggcgagaccacgcaccacgccgtcagccgcggctccgccaagttacaatggttcgtggagcggaacatggtgacgcccgaggggcgggtcatcgacctgggctgcgggcgcggcggctggagctactactgcgcgggactgaagaaggtgaccgaggtgcggggctataccaagggcggccccgggcacgaggagcccgtcccaatgtccacgtacggctggaacatcgtgaaactcatgagtgggaaggacgtgttctacctgccgcccgagaagtgcgacactcttctgtgcgacatcggcgagtctagcccctccccgaccgtcgaagaatcgcgcaccatccgggtgctcaagatggtggagccctggctaaagaacaaccagttctgtataaaggtcctgaacccctacatgcccacggtgatcgagcacctcgagcgtttgcagcggaagtacggagggatgttagtgcggaacccgctctctcgaaacagcacgcacgagatgtactggatctcaaacggcacaggcaatatcgtcagctccgtgaacatggtgagcaggctgctgctcaaccgattcaccatgacacaccgccgcccaaccatcgagaaggacgtcgacctgggcgccggcactcgccacgtgaacgcggagcccgagaccccgaacatggatgtaatcggggagagaatcaagcgcattaaagaggagcattccagcacgtggcactacgacgacgagaacccgtacaagacctgggcttaccacgggagctacgaagtaaaggccacaggcagcgcgtcatccatgatcaatggcgtggttaagctgctcaccaagccttgggacgtagtgcccatggtcacgcagatggccatgaccgacaccaccccgttcgggcagcagcgtgtgtttaaggagaaggtcgacacgcgcacgccccggcccatgcccggtacccgtaaggtaatggagatcaccgcagaatggctttggcgaacgttaggccgcaataagaagccccgtctatgcacccgtgaggagttcaccaaaaaggtccgcaccaacgccgccatgggggcagtgttcacggaggagaaccagtgggacagcgctcgggctgctgttgaggacgaggagttctggaagctggtggaccgcgagagggagctgcacaagctcgggaagtgcgggtcctgcgtctacaacatgatggggaagagagagaagaagctgggggagttcggcaaggcgaagggcagccgtgccatctggtacatgtggctaggagcccgatacctcgagttcgaggccctgggcttcctaaatgaggaccactggttcagccgggagaacagctattctggtgtcgagggcgaggggctccacaaacttggctatatcctccgggacataagcaagattccgggcggcgcaatgtacgcggacgacaccgccggctgggacacccggatcaccgaggacgacctccacaacgaggagaagatcacgcagcagatggaccccgaacatcgccaactggctaatgccatctttaagctgacctaccagaacaaggtggtgaaagtgcagcggcccaccccgaaggggaccgtgatggatattatatccagaaaggaccagcgtgggagcgggcaagtggggacctacggcctgaataccttcaccaatatggaggcccagctggtccgccagatggagggggagggagtactgtctaaggcggacttggagaacccccacctcctggagaagaagatcacccagtggctcgagactaagggggtggagcggctgaagcgcatggccatctccggcgacgactgtgtcgtgaagcccatcgacgaccggttcgccaacgccctgctcgccctgaacgacatgggcaaggtccgcaaggacatcccgcagtggcagccgtccaaggggtggcacgactggcaacaggtccccttctgcagccaccattttcacgagcttatcatgaaagacggccggaaactcgtcgtgccttgccggccccaggacgagttgatcgggagggcgcggatctcccagggcgccgggtggagcctgaaggagacagcctgcttgggcaaggcctacgcgcagatgtggtccctgatgtatttccaccgccgggatcttcgcctcgcgtccaacgcgatctgctccgccgtccccgtgcactggatccccaccagcaggaccacctggagcatccatgcccaccaccagtggatgacgactgaggacatgctgaccgtgtggaaccgcgtctggatcgaagacaacccttggatggaggacaagacccccgtgacgacctgggaggacatcccgtacttaggcaagcgggaagaccagtggtgcgggtcgctcatcggacttacctcccgcgcgacctgggcccagaacatactgacggctatccagcaggtacggtccctgatcggggacgaggagttcctggactacatgccctccatgaagcgctttaggaaagaggaggagtccgagggtgccatctggtga

SEQ ID NO: 26138 - RNA, 9873 nt, synthetic construct
  misc_feature 1..9873: note = derived and/or modified CDS sequence (opt11) from DENV-3__JQ045691__SS-prME
  source 1..9873: mol_type = other RNA
accagcctctgtctgatgatgatgctacccgcaaccctggcgttccacttaacgtcgcgagacggagaaccgcggatgatcgtaggcaaaaacgaacgtgggaaaagcctcctttttaaaaccgcgagcggaattaatatgtgcacgctgatcgccatggacctgggagagatgtgcgatgatacagtgacctacaaatgtccactcatagcagaagtggagccagaggacattgactgctggtgcaacctgacatcaacatgggtcacatacggtacgtgcaatcaagcaggcgagcacaggagagataaaagatctgtagcgctagctccacatataggcatggggctcgacacccgcacgcaaacatggatgtcggcagaaggagcctggagacaagtagaaaaggtggaaacctgggcccttagacaccccggcttcacaatcctcgcgctattcctagctcattatatagggacctcactgacccaaaaagtagtaattttcatcctcctaatgctcgtcaccccgtcgatgacaatgcgctgcgttggcgtgggaaaccgagatttcgtcgaggggctatccggagctacctgggtggacgtagtcctagaacacggaggctgcgtgacaacgatggccaaaaataaaccgaccctagacatagagttacagaaaacagaagcgacgcaattggcaacgttaagaaagctgtgcatagagggtaaaatcactaacatcacgactgacagccgatgtcccacacaaggagaggcaatcctgcccgaggaacaagatcaaaactacgtatgcaagcacacgtacgtagaccggggatggggaaacggatgtggactgttcggaaaaggttccctggtgacctgcgccaagttccaatgtttagagcccatagagggtaaagtcgtacagtacgaaaacctaaagtacacggtcatcatcaccgttcatacaggggatcaacaccaggtcggcaacgacacacagggagtcacggtagaaatcacaccgcaagccagcacagtagaagcaatactacccgaatacgggacgctaggactggagtgctcaccaaggacaggactagacttcaacgaaatgatccttctaacgatgaagaacaaagcctggatggtccaccgacagtggttcttcgacctacccctaccgtggaccagcggagcaacaacagaaaccccgacctggaaccggaaggaactcctagtaaccttcaaaaacgcgcatgccaagaaacaggaggtagtagtcctaggaagccaggagggagcgatgcacactgcgttaactggggcaactgagatacaaatatcgggtgggacatcgatattcgcaggacatttgaaatgcaggctcaaaatggataaactcgagctgaaaggaatgagctacgccatgtgcctaaatacgttcgtactcaagaaggaggtatcggaaacacaacatggcacaatactaatcaaggtagagtacaaaggcgaagatgcgccgtgcaaaatacccttcagcactgaagatggccaaggaaaagcccacaacggccgactgatcacggcaaaccccgtcgtaaccaagaaagaggagcccgtcaatattgaagcagagccgccctttggggagtcgaatatcgtcatcgggataggggacaaagccctcaaaataaactggtacaagaaaggatcatcgatcggaaaaatgtttgaggcgacagccagaggggcaagacgcatggcaatcctcggtgacacagcatgggactttggatcagtgggcggggtccttaattccctagggaaaatggtccaccagatctttggttctgcatacacagccttgttctctggagtctcatggataatgaaaatagggataggggtacttctgacgtggataggactaaactcgaagaacacatccatgagcttctcctgtatcgtgattgggataattactctatacctcggggcagtggttcaggctgacatggggtgcgcaattaactggaagggcaaagaattaaaatgtggcagcgggatcttcgttacaaacgaagtacacacgtggacagagcaatacaagttccaggcggacagccccaagcgattagcaaccgccatagcaggcgcatgggaaaatggagtgtgcggaatcaggagtaccacccgcatggagaacctcttatggaagcagatagccaacgagctaaactacatactatgggagaacaacatcaaattaaccgtcgttgtcggcgacatcataggggtactagagcagggcaagagaacgctgaccccgcaaccaatggagctgaagtatagttggaaaacatggggcaaagccaagatcgtgaccgccgaaactcagaactcttcatttataatcgatggtcccaacactccagaatgtccaagcgccagccgggcatggaatgtatgggaggtcgaggattatgggtttggcgtcttcaccacgaacatctggttgaaactgcgagaggtatatacacaaagttgcgatcataggttgatgagcgcagcgatcaaagatgaacgagccgtgcacgccgacatgggatactggatagagagtcagaaaaacggctcctggaaattagaaaaagcgagtttcatagaggtaaagacttgcacatggccgaaatcgcacaccctatggagcaacggagtgcttgaaagcgacatgataatcccgaaatcgttagcagggcccatctcacaacacaaccaccgccctggataccacacccagaccgccggaccgtggcacctcggcaagctagaactggacttcaattattgcgagggaactacggtagtaataacagaaaactgcggtaccagagggccatcactcagaaccacaacggtaagcggaaaactaatccatgagtggtgctgtcgaagctgcacactcccgcctctgagatacatgggtgaggatggatgttggtatggtatggagatacggccgattaacgaaaaagaagagaacatggtgaaaagcctagtctcggcaggatcgggaaaggtagacaactttacgatgggagtactatgcctggcaatcctgttcgaagaagtaatgagaggtaaattcggcaagaaacacatgattgctggcgtactattcacgtttgtgttgctattaagtggccagataacatggcgagacatggctcacacgctaatcatgatcggctcgaatgcctccgaccgaatgggaatgggagtgacgtacctggcactcatcgcgacattcaaaatacagccgttcctggcgctgggcttctttctgcgaaaattgacaagcagagagaacctgctgttgggtgtaggactcgctatggcaaccaccctacagctccccgaagacattgaacagatggctaacgggattgcgctaggcctgatgaccctcaaactaataacacaattcgaaacataccagctgtggaccgcactggtgtcactaacttgtagtaacacgatattcacgctcacggtcgcatggaggaccgccacgttaatattagcaggggttagcctcctaccgttatgccaaagttcttccatgcgcaaaaccgactggctcccgatgacggtagcggcaatgggagtgccgccactcccactgttcatattctccctaaaagatacccccaaaaagagatcttggccattaaacgagggtgtaatggctgtcgggttagtttctatattagcatcatccctactaaggaacgacgtacccatggcagggccgctagttgcaggagggctgctaatagcatgctacgtcataaccgggacctcagcggaccttaccgtagagaaagccgcggacgtgacgtgggaagaggaagcggagcaaaccggtgtttcgcataatttaatgatcacggttgacgacgacggaaccatgcgaattaaagacgacgaaacagaaaacatactcaccgtactcctaaaaaccgctctattaatagtgagtggcatctttccctacagtataccagctaccctcctggtatggcacacgtggcagaaacaaacacaaaggtcaggtgtcttatgggacgtgccgtccccacccgaaacccaaaaggcggaactcgaagagggagtgtaccgtatcaagcagcagggcattttcggcaagacacaggtgggcgttggggttcagaaagaaggcgtattccacacaatgtggcatgtaacacgaggggcagtcctcactcacaatggaaaacgcctagagccaaactgggcgagcgtgaagaaagacctaatcagttacgggggcggctggcgtctcagcgcgcaatggcaaaagggagaagaggtacaagtaatagcggtcgaaccaggcaaaaatcccaagaacttccaaaccatgccagggatcttccagacgacaaccggagaaattggagctatagccctagacttcaaaccaggcacgtccggaagcccaatcataaacagagaaggcaaagtggtggggctgtatggtaacggcgtcgtaaccaaaaacggagggtacgtaagcggcatcgcccagaccaacgcagaaccagacggcccaaccccggaattggaggaagaaatgttcaagaaaagaaaccttacgataatggacctacacccaggaagcggaaagacgcggaagtacctcccagccatcgtaagagaagcgataaagcgtcgcctcagaaccctaatactcgcgcccacacgtgtcgtagcggcggagatggaagaagcattaaaaggacttccaataagataccaaacaacagcaactaagagcgagcacaccggcagagagattgtcgatttaatgtgccacgccacattcacaatgcgactactgtcaccggtcagagtcccaaattacaacctgataataatggacgaggcgcacttcacagacccggcctccatcgcagcaaggggatacatcagcacacgcgtcgggatgggcgaagccgcagcaatcttcatgaccgcgacgccaccgggcacggcagaggcattccctcaatctaacgctccgatacaggacgaagaacgggacataccagagcggtcatggaacagcggaaacgaatggattaccgactttgtcggcaaaacagtatggttcgtacccagtatcaaggcgggcaatgatatagctaactgtcttcggaagaacggcaagaaagtaattcaactaagccgcaaaacgttcgacaccgaatatcagaaaaccaggctgaatgattgggacttcgtagtcaccaccgatatctcggagatgggggcaaatttcaaagccgatcgcgttatcgacccgcggagatgcctcaaaccggtaatattaaccgacggtcccgaaagagtgatactggcagggccaatgccagttaccgcagcgagcgccgcgcaaaggcgggggcgagttggacggaacccacagaaagaaaacgatcaatacatctttacgggccaaccactgaacaacgacgaggaccacgcccactggaccgaggcaaaaatgcttctagacaacatcaacaccccggaagggataatcccggcactcttcgaaccggaacgcgaaaaatccgcggcaattgatggagagtatcgccttaagggcgagtcgagaaaaacattcgtagagcttatgcgtcgcggagacctgccggtatggctagcccataaggtagcttctgaaggaataaaatatactgaccgaaagtggtgcttcgacggagaacgcaataaccaaatactggaagaaaatatggatgtagagatatggactaaggagggcgagaggaagaaactgcggcctcggtggctcgacgcacgaacgtacagcgatcccctggcactaaaggagttcaaagacttcgcagccgggagaaagagcatagcgctagacctagtcaccgaaatcggtagagtaccatcacatttggcacacaggacacgaaacgcactagacaacttggtaatgctacatacgtcagaacacggaggccgcgcttacagacatgctgtagaagaactccccgaaacgatggagactcttctactcctcggcctcatgatactactcacaggaggagccatgttattccttttgagtggcaaaggaatcggcaagacaagtatcggactcatctgcgtcatagtttcatccgggatgttatggatggcagacgtaccactacaatggatagcttcagcaattgtgcttgagttcttcatgatggtcttactaatcccagagccagaaaagcaaagaacgccacaggataatcaactggcttacgtggtcattggcatcctcacccttgcagcaatagtcgctgctaacgaaatgggcctactagagaccaccaaaagggacctggggatgtctaaggagcccggagtagtgtcacccacgagttacctagacgtggatctacaccccgcaagcgcgtggacgttgtatgcagtggcaacaacggtcatcaccccgatgctccgtcataccatcgaaaatagcacagcgaacgtgagccttgccgcgatagccaaccaggcagtcgtgttaatgggtctcgacaaagggtggccaatctcgaagatggacttgggcgtccctctcctggccctaggatgttactcccaggtcaatccacttaccctaacggccgccgtgctgcttctggtcacccactacgcgataatcgggcctgggctacaagcgaaagcaacacgagaagcgcaaaaacggaccgccgcgggaatcatgaaaaaccccaccgtagacggcattatgacaatcgaccttgacccagttatttacgattcaaagttcgaaaaacaattggggcaggtaatgttattggttctctgcgccgtccagttactgctcatgcgcaccagctgggcactctgtgaggccctcacgctagccacaggtccaattacgacgttgtgggaaggcagccccgggaaattttggaacactaccatcgctgtatccatggccaatatcttcagaggaagctacctcgctggagccggacttgcgttttcgataatgaagagtgtcggcacaggacgtcgcgggacggggagccagggagaaaccctcggggaaaagtggaagaagaaacttaaccaactttccaggaaggagttcgacctatacaagaaaagtgggataaccgaggtcgacaggacagaagccaaggagggactgaaacggggagaaacaacgcaccacgcagtatcgcgcggctccgcgaaattgcaatggttcgtcgagaggaacatggtgatccctgaaggcagggtgatcgacctcggctgcggccggggtggctggtcgtactactgcgccggtctgaagaaagtaacggaagtccgtggatacacaaaagggggccccggtcacgaggagccggtacccatgtcaacctacggatggaacctggtgaaattaatgagcggaaaggatgtattttaccttccgcccgaaaagtgcgacacgttgctctgcgacatcggtgaaagcagcccatcgagcacagtggaggagtcgagaaccatccgcgtgttaaagatggtggagccatggcttaaaaacaaccaattctgcatcaaagtattgaatccttacatgcccaccgtaattgaacacctagaaaggctccaaaggaaatacggaggcatgctcgtaagaaacccgctctcgcgtaactccactcacgaaatgtattggatatcgaacggcaccggtaacattgtcagttcggtcaacatggtgtcacgcttactactcaataggttcaccatgacgcacagaagaccaactatagaaaaagacgtagatctaggggcgggcacccgccatgtcaacgcagaaccagagacgccgaacatggacgtaatcggagagagaatcaagagaatcaaggaggagcacagctccacatggcactatgacgacgaaaacccctacaaaacgtgggcgtatcacgggagctacgaggttaaagctacgggcagcgcaagcagcatgataaatggggttgtgaaacttctcacaaaaccatgggacgtcgttcccatggtgacccagatggcaatgactgacacaacacccttcggccaacaaagggtgttcaaggagaaagtagacacaagaacaccccgtgctatgccgggcactcgcaaagttatggagatcaccgctgaatggttatggcgcaccctcgggcgtaacaagaaaccaagactctgcacaagagaagagtttacgaagaaagtgcgcacaaacgccgctatgggagcggttttcactgaagaaaatcaatgggactcagccagagcggcagtcgaagacgaagagttttggaagctcgtcgacagggaaagggagctccacaaactcggaaaatgcggcagctgcgtctacaatatgatgggaaaacgagagaagaaattgggggagttcggcaaggcgaaggggtcacgagcaatctggtacatgtggctaggggctcgctacctggagttcgaggccttaggattcctgaacgaagaccattggttctcccgggagaacagctactcaggagtagaaggggaaggcttacacaaattgggatacatcctgagagacatctccaagatacccggaggagcgatgtacgctgacgacaccgcgggctgggatacgcgcattaccgaagacgaccttcacaacgaagagaagataacccaacaaatggacccagagcatcggcaactagcgaacgcgatcttcaagctgacataccaaaacaaagtcgtcaaagtacagagacccactcccaaaggaactgtcatggatataatctcaaggaaagaccaaagagggtcagggcaagtagggacctacggtctaaacaccttcacaaacatggaagcccagctcgtgcgccaaatggaaggagagggagtcctatctaaggcagaccttgaaaactcccacctactcgagaagaaaataactcagtggctggaaacaaagggagttgaacgcctaaaacgtatggcgataagcggggacgactgtgtcgtcaagccaatagacgacagatttgcgaatgcgctactggcattaaacgacatgggcaaggtacgcaaagatatccctcaatggcagccctcaaaggggtggcacgactggcaacaagtccctttttgctcccaccacttccacgaactcataatgaaggacggcagaaaactcgtcgtaccgtgccgaccccaggacgaactcataggacgggccaggatctcccagggagcaggatggagccttaaggagacagcgtgcctgggaaaagcatatgcccagatgtggagcctcatgtactttcacaggcgtgaccttagattggcatccaacgccatttgcagcgctgtaccggtccattggatccctacgagcagaaccacctggtcgatacacgcccaccaccaatggatgacgacagaagatatgctgaccgtatggaatcgtgtgtggatcgaagacaatccgtggatggaagacaagaccccagtaacgacgtgggaagacgtaccctatctaggcaagcgtgaagaccagtggtgcggcagcctcatagggctgaccagcagagcaacgtgggcgcagaatatcctaacagcaatacaacaggtgaggtcactaataggtgacgaagagttcctggactatatgccctcgatgaaacgattccggaaggaagaagaatcggaaggcgcaatctggtag

SEQ ID NO: 26139 - RNA, 9873 nt, synthetic construct
  misc_feature 1..9873: note = derived and/or modified CDS sequence (opt11) from DENV-3__JQ045692__SS-prME
  source 1..9873: mol_type = other RNA
accagcctgtgcttaatgatgatgcttcccgccacactggctttccacctcactagtcgcgacggcgagccgcggatgatcgtgggcaagaacgagcgcggcaagagcctgttatttaagaccgcgagcgggataaacatgtgcaccctcatcgcgatggacctgggggagatgtgcgatgacaccgtgacgtacaagtgtccattaatcgccgaggtcgagcccgaggacatcgactgctggtgtaatcttactagcacatgggtgacatacggtacctgcaaccaggcgggtgaacaccggagagacaagcggagcgtcgccctggcgcctcacgtaggcatggggttggatacccgcacccagacctggatgagcgctgagggcgcctggcggcaggtagaaaaagtcgagacctgggccctccgccacccgggattcaccattctggcgctgttcctcgcccattacatcggcacctccctgacacagaaagtggtgatcttcattctgctcatgctcgtcacgccctcaatgaccatgcggtgtgtgggggtcggcaacagagacttcgtagagggactgtctggggcaacttgggtggacgtggtgctcgagcacggcggctgcgtgacgacgatggccaagaacaagcccaccctggacatcgagctgcaaaagaccgaggctacacagctagcgacgctgcgcaagctgtgcatcgagggtaagatcaccaatatcaccaccgactctaggtgccccactcagggcgaggccatcctcccggaggagcaggaccagaactacgtgtgcaagcacacctacgtggaccgagggtgggggaacgggtgcggcctgtttgggaagggctccctggtcacgtgcgccaagttccaatgcctcgagcccatagagggcaaagtggtccaatatgagaacctgaagtataccgtgatcatcacggtgcacaccggagatcagcatcaagtcgggaacgacacccagggggtgacagtcgagatcacgccccaggcgagtacggtcgaggccatcctgccagagtatggcacactcgggctcgagtgctccccccgcaccggcctggacttcaacgaaatgatcctcctgacaatgaagaataaagcgtggatggtgcatcggcagtggtttttcgacctcccgctcccctggactagcggcgccaccaccgaaacccccacgtggaaccgcaaggagcttctggtcacctttaagaacgcccacgccaagaagcaagaggtggtggtcttggggagtcaggagggtgcgatgcacaccgcattgaccggagccacggagatccaaatctcgggcggcacctccatctttgccggccatctgaagtgccggctcaagatggacaagctggagctgaagggcatgtcctacgccatgtgcctcaacactttcgtgctgaaaaaggaggtctccgagacccagcacgggactatcctgatcaaggtggagtacaagggcgaggacgccccgtgtaaaatccccttctctaccgaggatgggcagggcaaagcccacaatgggcggctgatcacggcgaatccggtggtgactaagaaagaggagcctgtcaacatcgaagccgaaccgcccttcggggagtcaaatatagtgataggcatcggggacaaagccctcaagatcaactggtataagaagggttccagcatcgggaaaatgttcgaggcgacggcgcggggcgcaaggcggatggcaatcttaggggacaccgcctgggacttcggttcagtgggcggagtcctgaacagcctcggcaagatggttcaccaaatctttgggtccgcttacaccgctctgttcagtggagtgtcctggatcatgaagataggaatcggggttctgctgacctggatcggcctgaactccaagaacacctccatgagcttttcatgcatcgtgataggaattataacactgtacctaggcgccgtggtccaggccgacatggggtgcgccataaactggaagggcaaagagctgaaatgcggaagcgggatattcgtgaccaacgaagttcatacgtggactgagcagtataagtttcaagccgactcaccgaaacgcctggccaccgccatcgccggcgcctgggagaacggtgtgtgcggcattcggtcaaccactcggatggagaacctcctgtggaagcaaatcgcgaacgagttaaattacatactctgggagaataacataaagttgacagtggtggtgggggacatcatcggcgtgctggagcagggcaaacggacgctgacgccccagccgatggagctgaagtactcctggaagacctggggcaaggccaagatcgtgacggcggagacacagaatagctcattcataatcgatggacccaacacccccgagtgccccagcgcctccagggcatggaacgtatgggaagtagaggattacgggttcggcgtgttcacaacgaacatctggctgaaattacgcgaggtctacacacagtcatgcgaccaccggctgatgagcgccgccatcaaggacgagcgcgccgtgcacgcagacatgggctactggatcgagtcccagaagaatgggagctggaaactggagaaggcgtcgtttatagaggtgaagacctgcacctggccgaaaagccacaccctctggtccaacggcgttctagagtccgacatgatcattcccaagtccctggcgggtcccataagccagcacaaccatcggccgggctaccacactcagacagccgggccctggcacctcggcaaactggagctggacttcaattactgcgaaggcacgactgttgtaattacagagaattgcgggacgcgcggcccttcgctcagaacaaccacggtctcagggaagctgatccacgagtggtgctgccgctcctgcaccctcccgccgctccggtacatgggcgaggacggatgctggtacggcatggagatcaggcctattaacgagaaggaggagaacatggttaagagcctagtgtccgccggcagcgggaaggtggataacttcaccatgggcgtcctgtgcctcgccatcctgtttgaggaggtgatgcgaggcaagttcggcaagaaacacatgatcgctggggtgctgttcaccttcgtgctcctgctgtccggtcagatcacgtggcgcgacatggctcacactctcatcatgataggcagcaacgcctccgaccggatggggatgggcgtgacatacctggccctgatcgcaacgtttaagatacagccgttcttagcgttagggttcttcttacgtaagctcacgagccgggagaacctgctgctcggcgtaggcttggccatggcaactacgctgcagctcccagaggacattgagcagatggctaacgggatcgcgcttggcctgatgaccttaaaactgatcacgcagttcgagacataccaactctggaccgccttggtctcactgacatgttccaatacgatcttcactctcacggtggcgtggcgcactgctacgctcatcctggcaggggtaagcctgctaccgctgtgtcaatccagctccatgcggaagaccgactggctgcccatgactgtggcggccatgggcgtgccgcccctccccctctttatcttcagcctcaaagacacaccgaaaaggcgctcctggcccctcaacgagggggttatggccgtgggactggtgagcatcctggcctcaagcctactgaggaatgacgtgcctatggccggcccacttgttgcgggtgggttactcatcgcctgttacgtcattacggggacgtccgccgacctgacagtagagaaggccgccgatgtgacctgggaggaggaggccgagcagacgggggtctcccacaacctcatgatcaccgtcgacgacgacgggacaatgcggatcaaggacgacgagaccgaaaacatactcacagtgttactcaagacggcccttctgatagtctccggcatcttcccttacagcatccccgctactctcctggtatggcacacctggcagaagcagacccaacgaagcggggtcctttgggacgtcccctctccgcccgaggctcagaaagcggaactcgaagagggggtgtaccgcatcaagcagcagggcatattcggaaagacccaagtaggagtgggggttcaaaaggagggcgtcttccacacgatgtggcacgtcaccaggggtgcggtgctgacccataacgggaagcgcctggagcccaattgggcgtccgtgaagaaagacctcatctcttacggtgggggctggcggctgtccgctcaatggcagaagggtgaggaagtccaggttatcgccgtggagccaggcaagaacccgaagaacttccaaaccatgcccggcatcttccagaccaccaccggggagattggcgcgatcgcgctggacttcaagcccgggactagcggaagccctataataaacagagagggaaaggtggtcgggctgtacggcaatggcgtcgtcaccaagaacggcggatacgtatccggcatagcccagaccaacgctgagccggacggccccacccccgagctcgaggaggaaatgttcaagaagcggaacctgaccatcatggatctgcacccggggagcggcaaaacccgtaagtacctccctgccatcgtgcgggaagctatcaagcggcgtctgcgtaccctgattctcgcccctacccgggtcgtggccgccgagatggaggaggccctcaaggggctgcccatacgatatcagactaccgcgaccaagtccgagcacacaggacgggagatcgtggaccttatgtgccacgcaacgttcaccatgagactgctgtcgccggtacgggttcccaattacaaccttatcatcatggacgaggcccacttcaccgacccggcctccatcgcagcgagaggatatattagcaccagagttggcatgggggaggccgccgctatctttatgacggccactccgcccgggaccgccgaggccttcccccagtcgaacgctcccatccaagatgaggagagagacatccccgaacgaagctggaactccggaaacgagtggatcacggacttcgtaggtaagacggtgtggttcgttccgtcaatcaaagccggcaacgacatagccaactgtctgcggaaaaacgggaagaaggtcatccaactctcccggaaaactttcgacaccgagtatcagaagacccgtctcaacgactgggatttcgtcgtgacgaccgacatcagcgagatgggcgcaaacttcaaagccgaccgcgtcatcgatccccggcgctgtctgaaacccgtgatcctgaccgacggccctgagcgcgtgatcctcgccgggccgatgcccgtcaccgccgcgtccgccgcacagcgccggggccgcgttgggcgaaacccccagaaggagaacgaccaatatatctttacaggccagcctctcaacaacgacgaggatcatgcccactggacagaggccaaaatgctgctcgacaacatcaacacccccgaagggatcataccagcgctgttcgagcccgagagagagaagtccgccgctatcgacggagagtaccggctgaagggtgagtcacgcaagactttcgtggagctcatgagacgcggggacctgcccgtctggctggcccacaaggtggcaagcgagggaatcaagtacaccgatcggaagtggtgcttcgacggggagaggaacaaccagatcctcgaggagaacatggatgtcgagatctggaccaaggagggcgagagaaaaaaattgcgcccgcgctggctggatgcccggacatacagtgatcccctcgccctgaaggagttcaaggacttcgccgctggcaggaagagcatcgcgctagaccttgtgaccgagatcgggcgggtgccctcccacctagcccaccgcacccggaacgcgctcgacaacctcgtcatgctgcacacgagcgagcatggcggtcgcgcctaccggcatgccgtggaagagctgccggagacgatggaaacctttctcttgctgggcctcatgatcctactgaccgggggcgcgatgctgttcctgctgagcggcaaggggatcggtaaaacatccatcgggctcatctgcgtcatcgtatcgtccggcatgctatggatggctgacgtgcctctgcagtggattgcatcggccatagtgcttgaattcttcatgatggtgctcctgatccccgagcccgagaaacagcgcacaccgcaggacaaccagctcgcctacgtcgtgatcgggattctgacattggcggccatcgtcgctgccaacgagatgggcttgctggagacgacaaagcgggacctgggcatgagcaaggagcccggcgtggtgagccccacctcctacctggacgtggacctgcatccggcgagtgcgtggaccctatacgccgtggccacaacggtcatcaccccaatgcttaggcatacaatagagaactctaccgctaacgtgagcctggcggccattgccaaccaggctgtcgtactgatgggactcgataaggggtggcccatctccaagatggacttaggcgttcccctgctcgcacttgggtgctatagccaggtgaaccccctgacgctcaccgcggcagtgctcttactcgtcactcactacgcgatcatcggcccgggcctacaggcgaaggcaactcgggaggcccagaagcgcactgccgccgggatcatgaagaaccccaccgtggacggaattatgaccatagacctggaccccgtgatctacgattccaaattcgagaaacagctcggtcaggtgatgctgctcgtattgtgcgccgtgcagcttttgctcatgagaaccagctgggcactgtgcgaggcgcttacgctcgccacgggccccatcactaccctgtgggagggctccccggggaagttctggaacacaacgatcgccgtatcaatggccaacatattccgtggctcctacctggcgggagccggtcttgcctttagcatcatgaagtccgtggggacagggcgacgcggcaccgggtcgcagggcgagacgctgggagagaagtggaagaagaaacttaaccagctcagccggaaggagtttgacctatacaagaaatccggcatcaccgaggtggaccgcaccgaggccaaggaggggctgaagcggggcgagactacccaccacgccgtcagccgcggctccgcgaagctccagtggttcgtggagagaaacatggttatacccgagggcagggtcatagacctgggctgcgggaggggcgggtggtcatactactgcgccggcctcaaaaaggtgacggaggtgcgaggctacaccaagggcggtcccgggcacgaagagcccgtgccgatgtccacctacggctggaacctggtgaaactgatgtcgggcaaggacgtcttctacctgccgccagagaagtgcgataccttactctgcgacataggcgaatccagcccctctagtacggtggaggagtcccggaccatccgggtgcttaagatggtggagccgtggcttaagaataatcagttctgtattaaggtcctcaacccatatatgccgaccgtgatcgaacaccttgagcgcctgcagaggaagtacggcgggatgctcgttagaaaccctctgagccgtaactccacccacgagatgtactggatcagtaatggaacgggcaacatcgtatccagcgtgaacatggtgagtcgcctgttgctgaatcggttcacgatgacacatcgccggccgacgatcgagaaggacgtcgacctgggcgccggtacgcgccacgtgaacgccgagcccgagacccccaacatggacgtcattggcgaacggatcaaacgcattaaggaagaacacagctccacctggcattacgacgatgagaacccttacaagacatgggcttaccacggaagctacgaagtgaaggcgacaggaagtgcctctagcatgatcaacggcgtcgtaaagcttttaaccaaaccctgggacgtggttcccatggtcacacagatggctatgacagacacaactccctttgggcaacagcgggtgtttaaagagaaggtggacacacgcaccccgagggcgatgcccggcacgagaaaagtcatggagatcaccgccgagtggctgtggcggacgctcggccgcaataagaagccccgcctgtgcacacgggaggagtttacgaagaaagtgcgcaccaacgcggccatgggtgccgtctttacggaggagaaccagtgggactccgcccgagcggctgttgaagacgaggagttctggaaactggtggacagggagcgggagttacacaaactaggcaagtgtgggtcgtgcgtgtataacatgatgggaaagcgcgagaaaaagctgggagagttcggtaaggccaagggatcccgggccatctggtacatgtggctcggtgcccgctacctggagtttgaggcgcttggctttctcaacgaggaccactggttcagccgggagaactcctactccggggttgagggcgaaggcctgcacaagctgggatacattctccgcgatatctccaagatcccaggtggtgccatgtacgcagacgataccgccggctgggacacgcgcatcaccgaggacgacctgcacaacgaggaaaagatcacccagcagatggacccggagcaccgccagctggccaacgctatcttcaagctcacctatcaaaacaaggtggtgaaggtccagcggcccacgcccaaggggaccgtgatggacattataagccggaaggaccaacggggctccggtcaggtgggcacctacgggctgaacaccttcacgaacatggaggcccagttagtgcgccagatggagggtgagggcgtgctgagcaaggccgacctggagaacccccacctcctcgaaaagaaaataacgcaatggctggagaccaagggcgttgagcggctcaagcgcatggccatctcaggggacgactgcgtcgtgaagccgatagatgaccggttcgccaacgcgctcctggcccttaacgacatgggcaaggtgcgcaaggacatacctcagtggcagccatcaaaggggtggcacgactggcagcaggtccccttctgctcgcaccacttccatgaactcatcatgaaggatggccggaagctggtggtgccgtgccgcccgcaggacgagctgatcgggagggcgcgtatcagccagggcgctggctggtccttgaaagagacagcctgcctaggcaaggcgtacgcgcagatgtggagcctgatgtacttccaccgccgggacctccggctggcctccaacgcaatatgcagcgcggtccccgtgcactggatccccactagccgaacgacgtggtctatacacgcccaccatcaatggatgaccaccgaggacatgctgactgtatggaatcgcgtctggatcgaggataacccgtggatggaggacaagacccccgtaaccacgtgggaggacgtaccttacctcggcaagcgggaagaccagtggtgcggcagcctaatcggcctgacctcccgtgccacctgggcccagaacatcttaaccgccatccagcaggtccgtagcctgatcggggacgaggagttcctggactacatgccttccatgaagcgcttccgcaaggaggaagaaagtgaaggcgcgatctggtga

SEQ ID NO: 26140 - RNA, 9873 nt, synthetic construct
  misc_feature 1..9873: note = derived and/or modified CDS sequence (opt11) from DENV-3__JQ045694__SS-prME
  source 1..9873: mol_type = other RNA
accagcctttgcctcatgatgatgctgcccgcaaccctggcctttcatctcaccagccgtgacggtgaaccgcggatgatcgtgggtaagaacgaaaggggcaagtcccttctgttcaagaccgcctctggaataaacatgtgcaccctgatcgccatggatctcggcgagatgtgtgacgacaccgtgacgtataaatgcccactgatagccgaggtggagcctgaagatatcgactgctggtgtaacctgacgagcacctgggtaacctatgggacgtgcaaccaggccggcgagcaccggcgcgacaagcgatccgtggccttggcaccccatgtggggatggggctggacacccgcacccaaacctggatgagcgcggagggcgcttggcgccaggtggaaaaggtggaaacttgggcgctgcgccacccaggtttcaccattctagcactgttccttgcccactatatcggcacgagcttaacccaaaaggtagtgatcttcattttactcatgctagtcacgccctcaatgacaatgagatgcgtgggagtgggcaacagggacttcgtcgaaggcctctccggggcgacctgggtggacgtggtcctggagcacgggggatgtgtgaccacaatggccaagaataaacccaccctggacatcgaactgcagaagaccgaggccacccagttagctacgctgcgcaaattatgtattgagggcaagatcaccaatatcaccaccgactctcggtgccccacgcaaggcgaagccattttgccggaggagcaggaccaaaactacgtgtgcaagcatacatatgtcgacagagggtggggcaacgggtgtggcctatttggtaagggatctctagtaacctgtgcgaaattccagtgtcttgagcccattgagggaaaagtggtccaatacgaaaacctgaaatacaccgtgatcatcactgttcacaccggcgatcaacaccaggtaggaaacgatacacagggtgtgaccgtggagataacgccacaggcctcgactgtagaggctgtgctgcctgaatacggaaccttaggactggagtgctcaccccgcactggcctggactttaatgaaatgatcctgctcacaatgaagaacaaggcctggatggtccaccggcaatggtttttcgatcttcccctcccgtggacctcaggcgccacgacggagacccctacctggaatcggaaggaattgctggtcacgttcaaaaacgcacacgccaagaagcaggaggtcgtagtgctcgggtcccaggagggcgcaatgcatacagcgctgaccggggccacggagatccagaacagcggcgggacctccatcttcgccggccacctgaagtgtaggcttaagatggacaaacttgagctgaagggcatgtcatacgccatgtgcctcaacacctttgtgttgaagaaggaggtctcagagacacagcatgggacgatcctaatcaaggtagagtacaagggcgaggatgctccgtgtaaaatcccctttagcaccgaagacgggcagggcaaagcacataacggccgcctgataactgccaaccccgtggtcacgaagaaggaagaaccagtgaacatcgaagccgaacctcccttcggcgagtccaacattgtcattggtatcggagacaaggcgctcaaaatcaactggtacaagaagggctccagtattggcaagatgttcgaggctaccgcccggggcgcccgcaggatggccatcctgggcgataccgcctgggactttgggtccgtcgggggtgtcctgaattcattgggcaagatggtgcatcagatattcggttctgcgtacacggcgcttttctccggcgtttcctggatcatgaagattggcatcggtgtactgctcacttggatcggcctgaactcaaaaaatacaagtatgagcttctcctgcatcgttatcgggatcatcaccctgtatctcggcgccgtggtgcaagccgacatggggtgcgccataaactggaagggcaaggagttaaaatgcggcagcggaattttcgtgacaaatgaggtccacacttggacggagcagtacaagttccaggcggactccccaaagcgtctggccaccgctatcgccggcgcctgggagaacggggtttgcggcatccgctccacaacccgaatggagaatctgttatggaagcagatcgcgaatgagctgaactacatcctctgggagaataacatcaagctgacggttgtggtgggggacatcatcggcgtgctggagcagggcaagcgcaccctaacgcctcagcctatggagctgaagtattcttggaaaacctgggggaaagccaagatcgtcacggccgagacacagaactcgtccttcatcatcgacggaccgaatacacccgagtgccccagcgcaagtcgtgcgtggaacgtatgggaggtggaggactatgggttcggcgtcttcacaactaacatttggctgaaactccgcgaggtgtacacccagtcctgcgaccatcggttaatgagcgccgcgataaaggacgagcgcgccgtgcacgcggacatggggtactggatcgagtctcaaaagaacggttcatggaagttagagaaggcttccttcatcgaggtcaagacctgtacttggccaaaaagccacaccctctggtctaacggggtgcttgaaagcgacatgatcatcccgaaaagcctggccgggcctatctcacagcataatcaccggccggggtaccacacacagaccgccgggccctggcacctcggcaagctggagctagacttcaactactgtgagggcaccactgtcgtcatcacggagaactgcggtacgcgtggcccctccctccggaccaccacggtgtctgggaagctaatacacgagtggtgttgccgcagttgcaccttgcctccgctccgatacatgggagaggatggatgctggtacggcatggagatacgccctatcaacgagaaggaggagaatatggtcaagtctcttgtctcggcaggcagcgggaaggtcgacaactttaccatgggcgtactgtgcctcgccatcctcttcgaggaggtaatgcgcgggaagttcggcaagaagcacatgattgcgggggtgctgtttacctttgtgctactgctgtccgggcagatcacgtggcgagatatggcccataccctcataatgatcggatctaacgcgtccgataggatggggatgggcgttacttatttagcgctgatagccaccttcaaaatccagcccttcctagcgctgggtttcttcttgcgaaaactcacgtcgcgggaaaacctgctgctcggggttggactggccatggctacaacgttgcaactccccgaagatatagagcaaatggcaaacgggatcgcgctgggcctgatgacactgaaattgatcacgcaatttgagacctatcagctgtggaccgcccttgttagccttacctgttcgaacacgatcttcaccctgaccgtagcctggcgcaccgctacgctaatcctggctggggtttcacttttgccgttgtgccaatccagcagtatgcggaaaaccgactggctgccgatgaccgtcgcggccatgggtgtgccccccctcccgcttttcatcttcagcctgaaggacacgccaaagcgcagaagttggcccctcaacgagggggtaatggccgttggcttggtctccatccttgcgtccagcctcctacgcaacgacgtgccaatggccgggcctctagtcgccggagggctattaatcgcttgctacgtgatcactgggacctccgcagacctgactgtggaaaaggccgccgacgtcacatgggaggaagaggccgagcaaacgggtgtgagccacaacctgatgatcaccgtggatgatgacgggaccatgcgcatcaaggacgacgaaactgagaatatactgaccgtgctcctcaaaacggcactgctgatagtctcaggcatctttccctacagcatccccgccacccttctggtgtggcatacctggcagaagcagacgcagcggagcggtgtgttatgggatgtccccagccccccagaaacccagaaggctgagcttgaggagggggtgtaccgtatcaagcagcagggcatattcggtaagactcaggtcggtgttggagtccagaaggaaggagtcttccacaccatgtggcacgtcacccggggcgccgtgttaacgcacaacgggaagagacttgagcccaactgggcatcggtgaagaaagacctcatttcttacggcggaggatggcggctgtccgctcagtggcagaaaggggaagaagtccaagtgatcgctgtcgagcccggcaagaacccgaagaacttccagaccatgcccggcatcttccaaaccaccactggggagattggggccattgcgctggacttcaaacccggcacttccggcagcccaataatcaacagggagggcaaagtcgtcgggttgtacggcaacggggtagtgaccaagaacggaggttacgtgtccggcatagcccagaccaacgccgagcctgatggacccacacccgagctcgaagaggaaatgttcaagaagaggaatctgaccatcatggacctgcatccggggagcgggaaaactcgtaaataccttcccgccatcgtgcgggaagctatcaaacgacggctgcgcacattgattctagcgcccaccagagtcgttgccgccgaaatggaagaggcccttaaggggctccctatccgttaccagacaactgctaccaaatccgagcacacgggccgggaaatcgtagatctcatgtgccacgccaccttcacaatgcgactgctgtcaccgattcgggtgccgaactacaacctcatcatcatggacgaagcgcactttacggacccggcgtccatcgccgcccgcgggtatatttcaacgcgggtaggcatgggcgaagcggctgccatatttatgaccgctacaccgcccggaaccgctgaggccttcccccagtcgaatgcgcccattcaggacgaagagcgcgacattccagagcgcagctggaacagtggcaatgaatggatcaccgacttcgtcgggaaaaccgtgtggttcgtgcccagcatcaaggccggcaatgatattgcgaactgtctccggaaaaacgggaaaaaggtcatccaactgtcccgcaagacgtttgataccgaataccagaagacgcgcctcaacgactgggattttgtggtgactacagacatcagtgagatgggcgcgaacttcaaggcggacagggtcattgatccccggagatgcctcaagcccgtgattctaacggatggcccagaacgtgtgatcctcgcaggaccgatgcccgtcacagctgcttccgcggctcagcgccggggccgcgttgggcggaacccgcagaaagaaaatgaccagtacatattcaccggccagccgctaaacaatgatgaagatcacgcccactggaccgaggccaagatgctgctggataatatcaacaccccggagggaattatccccgccctgtttgagcccgagcgggagaagtccgcagcaatcgacggagagtaccgactgaagggtgaatcaaggaaaacctttgtagaactcatgcggcgcggggaccttcccgtgtggctggcccacaaggtggcgagcgagggaataaagtacactgaccggaagtggtgctttgacggggagcgcaataaccagatcctcgaggaaaacatggatgtcgagatttggacgaaggagggggagcggaagaagctgcgcccgcgctggctggacgcgcggacctactctgacccgctcgcgttaaaggaatttaaagactttgccgcgggccgcaagagtatcgcacttgatctcgtgaccgaaattgggcgggtgccctcccacctggcgtaccggacgcggaatgcgctggacaacctcgtcatgctacacaccagcgagcatggcgggcgcgcctatcgtcacgccgtggaagagctgccagagacgatggagaccctcctgctgcttggcctgatgattctcctcaccgggggagccatgctgtttctaatgagcggcaaggggataggcaaaacgtccatcggcctcatatgtgtcattgtaagcagcggaatgttatggatggcggacgtccctttacagtggattgccagcgccatcgtcttggagttcttcatgatggtactgctcataccagaacccgagaagcagcgcaccccgcaggataatcagctcgcctacgtggtgatagggatacttaccctggcagcgatcgtcgcagcaaatgagatgggtctcctggaaacgaccaagcgggacctggggatgtccaaagagcccggcgtcgtttctcccacctcctacttagacgttgacctgcaccccgcttctgcctggacgctttacgcggtggccacgaccgtaatcacaccgatgcttcgccacaccatcgagaactccactgccaacgttagcctggccgccattgccaaccaggctgtggtcctgatgggcctcgataagggatggcctatctcgaagatggacctgggcgtacccttgctcgccctagggtgttacagccaagtgaaccccctgaccctgaccgctgcggtgctactgctcgtgacccattatgccatcatcggcccgggcctccaggctaaggcgacgcgggaggcccagaagcgcaccgcggctgggataatgaagaaccctaccgtcgatggcatcatgaccattgacctggaccccgtaatctacgactccaaattcgagaagcagcttggtcaagtcatgctcctggttctctgcgccgtgcagctgttgttgatgcgtacgtcttgggccctgtgcgaggccctgaccttagccaccggtcccatcactacgttatgggagggttccccggggaaattctggaacacaactatagccgtcagtatggccaacattttccgcggctcatacttagccggagcgggactcgccttcagcatcatgaagtccgtggggacgggccggcgcggcacggggccacagggcgagaccctgggggagaagtggaagaagaagctgaaccagctttcacgaaaggaattcgatttgtacaagaagtccggaataaccgaggtagaccgcaccgaggccaaggaggggctgaagaggggggagacgacgcaccacgccgtatccagagggagcgccaagctacaatggttcgtggagcgcaacatggtcattcccgaagggcgcgtcatagacctggggtgcggtcggggcggctggtcatattactgcgcaggcttgaagaaagtgaccgaggtgcggggctacaccaagggcggccccgggcacgaggagccggtcccaatgtctacctacggctggaacctcgtgaagctgatgagcggccgcgacgtattctatctgccacccgagaaatgcgataccctgctgtgcgatatcggcgagagctccccttcacctacagtggaggagtcaaggaccatccgcgtgctgaagatggtggaaccctggctgaagaacaaccagttctgcatcaaagtcctcaacccctacatgccgacggtgatcgagcatttggagcggctacaacgcaagtatggaggcatgttggtgcggaatcccctgagccgcaattccacgcacgaaatgtactggataagcaacggcacaggcaacatcgtctcgagcgtgaacatggtgtcgcgtcttctactaaacagattcactatgacccaccgtcgtcccaccatagaaaaggacgtagatctaggtgcaggaacccggcacgtaaatgccgagcctgaaacccccaacatggacgtcataggggagcgcatcaagcggatcaaggaggagcacagcagcacctggcattacgacgacgagaacccctacaagacttgggcctaccatggtagctatgaggttaaggccaccgggtccgctagcagcatgatcaacggcgtggtcaagctcttgacaaagccctgggacgtcgttccgatggtcacccaaatggccatgacagacacaacccccttcgggcagcagcgcgtgttcaaggagaaagtagacacaaggacgccaaggcccatgccgggtacgcggaaggtcatggagatcaccgccgaatggttgtggcgcaccctgggtcgcaataagaaaccccgactgtgcacgcgggaggagttcacgaaaaaagtgcgtactaacgccgcgatgggagcagtttttaccgaggaaaaccagtgggacagtgctagagctgccgtcgaagacgaggagttctggaaactggtggacagggagcgcgaactccacaaactgggcaaatgcggatcatgcgtgtacaacatgatgggtaaacgggagaagaagctgggggagtttggtaaagcaaagggctcccgtgcgatctggtatatgtggttgggggcccggtacctggagttcgaggcccttggtttcctgaacgaggatcactggtttagccgggagaacagttatagtggcgtcgagggcgagggtttgcacaagctgggttacatactaagagacatctctaaaatccccggcggggccatgtacgcggatgatacggctggatgggatacccgcataacagaggacgaccttcacaacgaagagaagatcacccagcagatggaccccgagcatcggcagctagccaatgccatcttcaagctgacttatcagaacaaggttgtgaaggtccagagaccgacccccaagggtaccgttatggatattataagcagaaaggaccaaagaggctccggacaggtgggcacctacggcctgaatactttcacgaatatggaggctcaactcgtccgacaaatggagggagagggcgtcctcagcaaggcggacctggagaacccccatctcttagagaagaaaatcacccaatggctagagaccgagggagtggaacgcctcaagcggatggccatctccggcgacgactgtgtcgtgaagccgatagacgaccgcttcgcgaacgctctcctggctcttaacgacatgggcaaggtacgcaaggatattccacaatggcagccgtccaaggggtggcatgactggcaacaggtccccttctgcagccaccacttccatgagctcatcatgaaggacggacgaaaacttgtggtcccatgccgcccccaggacgaactcatcgggcgggctaggatcagccagggtgccgggtggtccctcaaggaaacggcatgtctggggaaagcctacgcacagatgtggagcttgatgtatttccaccggcgcgacctgaggctggcgtccaacgcgatatgctcggccgtaccggtacactggatacccacgtcccgaacaacgtggagtatacacgcccaccaccagtggatgaccacggaggacatgctcaccgtgtggaacagggtttggattgaagacaatccctggatggaggacaagaccccggtgaccacttgggaagatgtcccgtacctcgggaagagagaggaccagtggtgcgggagcctgattggtctgacctcacgggcgacatgggcccaaaacatcctcacagcgattcagcaggtccggagcctgattggcgacgaggagtttctggactatatgccctccatgaaacggtttcgcaaagaggaggagagcgaaggcgccatttggtga

SEQ ID NO: 26141 - RNA, 9873 nt, synthetic construct
  misc_feature 1..9873: note = derived and/or modified CDS sequence (opt11) from DENV-3__GU363549__SS-prME
  source 1..9873: mol_type = other RNA
accagcctgtgcctcatgatgattctacccgccgccctggcgttccaccttacttcacgggacggagagccgcggatgatcgtggggaagaacgagcggggaaagagcctgttgtttaagactgcctccgggataaacatgtgcactctcattgccatggacctgggcgagatgtgcgacgataccgttacctataagtgcccacacatcaccgaggtggagccagaggacattgattgctggtgcaacctcaccagcacctgggtgacgtacgggacctgcaaccaggccggtgaacaccgccgggacaaacgatccgtagccttagcgccccacgtgggcatggggctggacaccaggactcagacctggatgagcgcagagggcgcttggaggcaggtcgagaaggtggagacatgggcattgcgtcaccccgggttcaccatcttagctctgttcctggcccattatattggcacatccctcacccagaaggtggtgatcttcatcttgctgatgctcgttacacccagcatgacgatgcggtgcgtaggcgtgggtaatcgagattttgtcgaaggcctgtccggggccacctgggtggatgtggtcctggagcatggcggatgcgtgaccacgatggccaaaaacaagcccacgctggacatcgagctgcagaagaccgaggccacccagctggcgactttgcggaaactgtgcatcgagggtaagatcaccaacatcactaccgactcacggtgccccacccagggcgaggccgtgctgcctgaggagcaggatcaaaactacgtctgcaagcacacatacgtggaccggggttggggcaacgggtgcggcctcttcgggaaggggtcgctggtaacctgtgcgaagttccagtgcctggagcccatagagggcaaagtcgtgcaatacgagaacctcaagtacacagtgattataacggtccacaccggggatcagcatcaagtggggaacgagacccagggtgtcacagcagagatcacgcctcaggccagcaccaccgaagctatcctacccgagtacggtacccttgggcttgagtgctccccacgcaccggcctggatttcaacgagatgatcctactcacgatgaagaacaaagcctggatggtgcataggcagtggttcttcgatctgcccctcccctggaccagcggcgccaccacggagacgcccacgtggaaccgtaaggagctactagtgaccttcaagaacgcacacgcaaagaagcaggaggttgtggtgctggggtcccaggagggcgcaatgcacacagcattaacgggggccaccgagatacagaattccggcgggacatccatcttcgcgggccacctaaagtgccggttaaaaatggacaagctcgagctgaaaggcatgtcatacgccatgtgcacaaataccttcgtcctgaagaaggaggtgtccgagacccagcatgggaccatcctcatcaaggttgaatacaagggcgaggacgcgccttgcaagattccctttagcacggaggacgagcaggggaaggcgcacaacggccgcttaataaccgccaaccccgttgtaacaaagaaggaggagcctgttaacatcgaagcagagccgccctttggcgagagcaatatagtcatcgggatcggggacaacgcgttaaaaattaactggtacaaaaaggggtctagcatcggcaagatgttcgaggccaccgcccggggggcgcgccggatggccatcctgggcgataccgcgtgggacttcggatccgtcgggggcgtgttgaacagcctaggtaagatggtccatcaaatcttcggctccgcctacaccgcgcttttcagcggggtatcctgggtgatgaagattggcatcggggtactcctgacctggatcggcctgaacagcaagaacacctcaatgagcttctcctgcatagcaatcggaattataactctgtatcttggggccgtagtgcaagcggacatggggtgcgtcatcaactggaaagggaaggagctgaagtgtgggagcggcatcttcgtgacgaacgaagtgcacacctggaccgagcagtacaagtttcaggccgactcccccaagcgcctcgccactgcaattgccggtgcgtgggagaacggggtctgtgggattcgaagcacgacccggatggaaaacctgctgtggaagcagattgccaacgagctcaactacatactctgggagaacaacataaagttgaccgtggtggtcggcgacaccatcggggtactcgagcagggcaagcgcactctgacgccccagcctatggagctgaagtactcctggaagacctggggcaaggccaagattgtgaccgccgagacacagaactcgtcttttatcatcgacggccccaacactcccgaatgcccgagcgcgtcccgggcttggaatgtgtgggaggtggaggactacggcttcggagtcttcacgaccaacatctggctcaagctgcgtgaggtctacacccagatgtgcgaccaccggctgatgagcgccgccgtgaaggacgagcgcgccgtgcacgcggacatgggctactggatcgagagccagaaaaacggatcgtggaagctcgagaaagcgagtctgatcgaagtgaagacgtgcacatggccaaagtcacacaccttatggagtaatggggttctagagtccgatatgataatccccaagagcctggccggccccatctcgcagcacaattaccggccaggctaccacacccagacggccggcccctggcacctgggtaagctcgagctggactttaactattgtgaagggaccactgtcgtcattacggaaaactgcggcacgcgaggaccctctttacgcaccaccacggtgtctggtaagctcatccatgagtggtgctgtcgctcgtgcacgctgcccccactgcggtatatgggagaggacggatgctggtacgggatggagatcagacccatctcggaaaaggaggagaatatggtcaagagcctcgtttcggccggcagcggcaaggtggacaacttcaccatgggggtgctgtgtctggccatcctcttcgaggaggtaatgcgggggaagttcggtaagaagcacatgatcgccggggtgttcttaaccttcatgctcctcttgagcggtcaaatcacctggcgcgacatggcccacacgttgattatgatcggcagcaacgcatcggaccgaatgggcatgggtgtgacttacctcgccctgatcgcgactttcaagatccagccattcctggccttgggtttctttttgcggaagctgaccagccgtgagaatcttctgttgggggttggcctcgccatggcaacgaccatacaactgccagaggatatcgagcagatggcgaacggcatcgccctggggctcatggcactgaagctgattacccaattcgagacgtaccagctctggacggccctgatcagccttacctgttccaacaccatctttaccctcaccgtcgcctggcggacagcgaccctgatcctggctggcgtgagcctccttccggtgtgtcagtctagctccatgcggaagaccgactggctgcccatgacggtggcggccatgggggtgcctccgctcccactgttcatattctctctgaaggataccttgaaaaggcgtagctggcctctgaacgagggtgtcatggccgttggcctggtgagcattctcgcttccagcctgctacggaacgacgtccccatggccgggcccctcgtggccggcgggctgctcatcgcctgctacgtcatcactggaacctccgccgatcttacagtggagaaggcggctgatgtgacgtgggaggaagaggccgaacagaccggggtcagccacaaccttatgatcaccgtggatgacgacggcaccatgcgcatcaaggacgatgagacggagaacattcttaccgtactactcaagacggcactgctcatcgtctccggcattttcccgtacagcatccccgccaccctgctggtgtggcacacctggcagaaacagactcagaggtccggcgtgctatgggacgtcccctctccaccggagacccagaaggcggaactggaggagggggtgtaccgcattaagcagcagggtatactgggtaaaacccaggtgggcgtcggagtccaaaaagagggggtgttccacacaatgtggcacgtcactagaggcgcagtgctcacccataacggcaaacgcctggagccgaactgggcctccgtgaagaaggacctgatcagctacggaggcgggtggcggctctcagcccagtggcagaagggcgaggaggtccaagtgatagcggtcgagccaggaaagaaccccaagaactttcagaccatgccaggcaccttccagaccacgactggcgagataggagcaatcgccctggacttcaagcctgggacgagcggtagccctataataaaccgtgagggcaaagtggttgggctgtacgggaatggcgtggtcaccaagaacgggggctacgtgtccggcatcgcccaaacaaacgccgaaccggacgggcctacacccgagttggaagaagagatgttcaagaaaagaaacttaacgataatggacctgcaccccggtagcggtaagacccgaaagtacctgcctgcaattgtgcgcgaggccataaagcgccggctccgcaccctaatcctggcccctacccgggtagtggccgccgagatggaggaagcgctcaagggcctgcccatacgataccagacgactgccaccaagagcgaacacactgggcgagagatcgtggatctgatgcgccatgccacgttcaccatgcggctcctgagccctgttcgcgtgccgaactacaacctgatcattatggacgaggcccacttcaccgaccccgcatccatcgcggcacgggggtacatcagcacgcgcgtcggaatgggcgaggccgctgcgatcttcatgacggccacgccgccgggaactgccgacgccttccctcaatcaaacgcccccatccaagacgaggagagagacatacccgagcgcagctggaattccgggaatgagtggatcaccgacttcgcgggcaagacggtctggttcgtacccagcatcaaagcagggaacgacatcgctaattgcctacgaaagaacggaaagaaggtgatccagctgtccaggaaaaccttcgataccgagtaccagaagaccaagcttaatgactgggacttcgttgtcacgacagacatctcagaaatgggcgccaacttcaaagccgatagagtgatagatccgcggcgctgcctcaagcccgtcatcctgaccgacggtccagagcgcgtgatcctcgcaggtcctatgccagtgaccgtcgcttccgcagcccagcgccgggggcgtgtgggccgaaacccgcaaaaggagaacgatcagtacatatttactgggcagccactcaacaatgacgaggaccacgcgcactggaccgaggcaaagatgctgctggacaacataaacacccccgagggcatcataccggccctcttcgagcccgaacgcgagaaatccgccgccatagacggagagtacaggctgaagggcgaatcccgcaagaccttcgtggagctaatgcggcgcggagatctgcctgtctggctggcgcacaaggtggccagcgagggtatcaagtacaccgaccggaagtggtgttttgacggccagcgcaacaatcagatcctagaggagaacatggacgtcgagatctggaccaaagagggggagaagaagaagctccggccccgctggctggatgcacgcacttattcggaccctctggccctcaaggagtttaaggactttgccgcgggtcggaagagtatcgccttggacctagtgacagaaattggcagggtgccgagtcacctcgcccacagaactcgcaacgccctggacaacctagtaatgttgcacacgagcgagcacgggggacgggcgtaccgccacgcggtagaagaactgcccgagaccatggagaccttgctcctgctggggcttatgattctgctgaccggaggcgccatgctgttcctgatcagcgggaagggcatcgggaagacgtccatcggactgatctgtgtgattgccagctccgggatgctctggatggccgagataccgctgcagtggatcgcgtctgccatcgtcctagagttcttcatgatggtgctcctgatacccgagccggagaagcagcgaacgccccaggacaaccagctggcctatgtggtcatcgggatcctcaccctggcagccattatcgccgcgaacgagatggggctgcttgagaccacaaagcgcgacctgggcatgagcaaggagccgggcgttgtgagccccacatcctacctggatgtagacctccatccagccagcgcctggaccctctacgccgtggcgacaaccgtgatcacccccatgctgcggcacaccatcgagaactccacagccaatgtaagcctcgccgccatagctaaccaagcggtcgtgttaatggggctggacaagggctggccgatttccaagatggacttgggagtccccctgctggctctcgggtgctactcccaggtgaaccccctgacgctgacagctgccgtcctcctgctcgtcacccactacgcgatcatcggccctggcctgcaggccaaggccacccgcgaggcccagaagcggacggccgccggcatcatgaagaaccccactgtggacggaatcatcaccattgacctagacccagttatctacgacagcaagtttgagaagcagctggggcaggtcatgctcttggtgctctgcgccgtgcagctccttctgatgcgcaccagctgggccctctgtgaggcgctgacgctggccaccgggccaatcactaccctgtgggagggctccccaggcaaattctggaacacgaccatcgctgtctcgatggcaaatatcttccgggggtcctacctcgccggcgcagggttggccttttccatcatgaagtccgttggcacaggaaaacgcggaactggcagccaaggggagaccctcggcgagaagtggaaaaagaagttgaatcagcttagccgaaaggagttcgacctctacaagaaatctggaataacggaggtggatcgcacggaggcgaaggaggggctcaagagaggtgaaaccacacaccacgccgtctctcgcggctccgcaaaactgcagtggtttgtggagcggaacatggtgatcccggagggccgcgttatcgacctcgggtgcggccgcggcggctggagctattattgcgcaggactgaagaaggtaacggaagtgcgcggctacaccaagggcgggcccgggcatgaagagcccgtccccatgagcacccacgggtggaacatagtgaagctgatgtctggaaaggatgtattctatctaccgcccgagaagtgcgacaccctgttatgcgacattggagagtcatcacccagccccacggtcgaggaaagccgcaccatccgggtgttaaagatggtggaaccgtggctcaagaacaaccagttctgcattaaggtcctaaacccctacatgccggcagttatcgagcatcttgagcgcttgcaaagaaagcacggaggcatgctggtcaggaacccactgtcccgtaactcgacccatgaaatgtactggatctccaacggaactggcaatatagtcagctccgtaaacatggtgagccgcctactcttaaaccggtttacgatgactcatcggcggccgaccatcgaaaaggatgttgacctaggggctggcacccgccatgtaaacgcggagcccgagacgcccaatatggacgtaatcggcgagcgcatcaggcggattaaggaggagcacaactccacctggcattacgatgacgagaacccgtacaagacctgggcctaccacgggtcctatgaggtaaaggccaccggctccgcatcgagcatgatcaacggcgtcgtgaaactactgacgaaaccctgggatgtagtgcccatggtcacccagatggcgatgaccgacaccacgccgtttggccagcagagagtgttcaaggagaaagtggacacgcggacccccaggcccatgcccggaacccggaaggtcatggaaatcacggccgagtggctctggcgcacgctgggacggaacaagcgcccccgcctgtgcacgcgggaggagttcaccaagaaggtccgaactaatgctgcgatgggtgcggtgttcaccgaggagaaccagtgggactccgccaaagccgccgtcgaggacgaggagttctggaagctcgtggaccgggagcgcgagctacacaagctggggaagtgcgggtcctgcgtgtacaacatgatggggaagcgggagaaaaagctcggtgaatttgggaaagcgaaaggctcgcgtgcgatctggtacatgtggctgggagcccgttacctggagtttgaggccctcgggttcctgaacgaagaccactggtttagccgagagaactcctactcaggcgtcgagggagagggtctgcataagctcgggtacatccttcgggacatctccaaaatccctggcggagcaatgtacgcagacgacaccgctggatgggacacgcgcattacggaagacgaccttcacaacgaggagaagattacccagcagatgaacccagagcaccggctcctggctaacgcaatctttaagctgacctaccagaacaaggttgttaaggtccagcgccccacccccacaggcacagtgatggacatcatttctcggaaagatcagcgcgggtccggccaggtggggacctacgggttgaacaccttcaccaacatggaagcccagctcgtcaggcaaatggaaggcgagggggtgctgtctaaggccgacctcgagaacccgcacctgccagagaagaagatcacgcagtggctggagactaagggggtggagcgcctcaagcggatggcgatctccggtgacgactgcgttgtgaaaccaatcgatgatcgtttcgctaatgccctgctggccctcaacgacatgggcaaagtgcggaaagacattccccagtggcaaccgtccaaaggctggcacgattggcagcaggtccccttctgttcccaccactttcacgagctgattatgaaagacgggcgcaagctagtggtgccctgtcggccccaggacgagttgatcggccgcgctcgcatcagccagggtgccggctggtcactgcgtgagaccgcatgtctggggaaagcttacgcccagatgtggagcctcatgtatttccatcgccgggatctgcgcctggcgtccaacgccatctgcagcgccgtcccggtgcactgggttcccaccagccggaccacctggtctatccacgcccaccaccagtggatgaccacagaggacatgttgaccgtatggaatcgcgtatggatcgaggacaatccgtggatggaggataaaacacccgtgaccacctgggagaacgtaccgtacctaggcaagcgggaggaccagtggtgcggcagcctgatcgggctaacatcccgagctacttgggcacagaacatcagcaccgctattcagcaagtccggagcttgattggcaacgaggagttcctggattacatgcccagcatgaagcgattcagaaaggaagaggagtccgagggggccatctggtga

SEQ ID NO: 26142 - RNA, 9873 nt, synthetic construct
  misc_feature 1..9873: note = derived and/or modified CDS sequence (opt11) from DENV-3__KJ622197__SS-prME
  source 1..9873: mol_type = other RNA
accagcctgtgcctgatgatgatgctgcccgccaccctggcgtttcacctcaccagccgtgacggtgagccccgtatgatcgttggaaagaacgagcggggcaagagcctgttgttcaagacggcgagcggtatcaatatgtgcaccctcatagccatggatctgggcgagatgtgcgacgacactgtaacctacaagtgtccccttatcgccgaggtggagcccgaggacatcgactgctggtgcaacttaacatcgacctgggttacctacggaacgtgcaatcaggccggcgaacaccggagggacaaacggtcggtggccctggcgccacacgtgggtatgggactggacaccagaacccaaacctggatgagcgcggaaggcgcctggcgtcaggtggagaaagtcgaaacctgggcgcttcgacatcccggtttcaccatactagcgctattcctagcccactacattggcacgtccctcacccagaaggtggtgatattcatactgctgatgctggtcactccctccatggccatgcggtgcgtgggcgttggcaatcgcgacttcgtcgaaggcctaagcggagcgacctgggtggacgttgtgctcgagcacggtgggtgcgtaacaacgatggccaagaataaacccacactggacattgagctgcagaaaaccgaggcgacccaactcgcgaccctgcggaagctgtgcatcgagggtaagatcacgaacattacgaccgacagccgctgccccactcagggcgaggcgatcctccccgaagagcaggaccagaactacgtgtgtaagcacacgtacgtcgatcgggggtggggcaatggttgcggcctgtttgggaaagggtctctggtaacctgcgctaaatttcagtgcctcgagagcatagagggaaaagtagtccagcacgagaaccttaaatatacagtgacgatcacagtccacaccggggaccagcaccaggtcggcaacgacacccagggggtgactgccgaaatcacgccccaggcgagtaccgtcgaagcgattctgcccgagtacggcaccttgggactggaatgcagcccgcgcactggcttggatttcaacgaaatgatcctcctgaccatgaaaaacaaggcgtggatggtacaccgtcaatggtttttcgacctgccgttgccgtggacgtcaggcgccatcaccgagacccccacttggaacaggaaggagctactggtgacgttcaagaatgcccacgctaagaagcaagaggtcgtggttctggggagccaggagggggccatgcacacagccttaaccggggccaccgagatccagaacagcggtgggacgagcatcttcgccggccacctgaagtgccgtctgaagatggacaagctggagcttaaggggatgtcctacgcgatgtgcctcaacacctttgtgctgaagaaggaggtgagcgaaacccaacacgggactatactgatcaaggtggagtataagggcgaggacgcgccctgcaaaatcccattcagcacggaggatgggcaaggcaaagcccacaacggccgcctgattaccgccaaccccgtcgtgacaaaaaaggaggagcccgtgaacatcgaggctgagcccccgttcggagagtccaacatcgtcattggtataggggacaaggcccttaagatcaattggtataaaaagggctcttcaatagggaagatgttcgaggccaccgcgcggggcgcgcgccgtatggccattctaggcgacacggcttgggacttcggaagcgtgggaggggtactgaactccctaggcaagatggtgcatcagatcttcggaagcgcctacacagccctgttcgggggtgtttcctggatcatgaagatcggaatcggcgtgctgctcacatggatcgggctgaactccaagaacacgagtatgagcttttcctgtatcgtgatcggcatcatcacgctttatctcgggaccgtcgtacaggccgacatgggctgcgtcatcaactggaaggggaaggagctgaaatgcggaagcggaatcttcgtgaccaacgaagtgcacacctggacggagcagtacaagttccaggcggatagtcccaagcgcctggccacagccatcgccggggcctgggaaaacggcgtctgcggcatccgcagcaccacccggatggagaacctactgtggaagcagatcgcgaatgagctgaactacatcctctgggagaacaacatcaagttaacggtggtggtcggcgacatcataggcgttctggagcaggggaagcgcacgctcacgccccaacccatggagttaaaatactcttggaagacctgggggaaggccaagatcgtgacggcagagatccagaacagcagtttcatcatcgacgggccaaatacacccgagtgcccctctgcctcccgggcgtggaacgtctgggaggtggaggactacggcttcggcgtgttcacgaccaacatctggttaaagcttcgagaggtttacacgcaaacttgcgatcatcgtctgatgtccgccgccataaaggatgagagggccgtccatgccgacatggggtactggattgagtctcaaaagaacggctcctggaagttagaaaaggcgtcattcatcgaggtgaagacctgtacctggcctaagtctcataccctatggtcgaacggggtcctggaatccgacatgatcattccgaaaagcctggccggacccatttcccagcacaaccataggcccgggtaccacacgcagaccgccggcccgtggcatctgggcaagttagaactggacttcaattactgcgaggggaccaccgtggtgatcacggagaactgcgggaccagaggtcccagcttgcggaccaccacggtctccggcaaactgatccacgaatggtgctgccgcagttgcaccctcccgcccctgcggtacatgggagaggacggctgctggtacggcatggagatccgcccaatcaacgagaaggaggagaacatggtgaagtccctggtgagcgcgggttctggcaaagtcgacaactttacgatgggggtactgtgcctcgccatactattcgaggaggtgatgcggggcaagttcgggaagaaacacatgatcgccggcgtccttctcacgtttatgctgttgctaagcggccagattacttggcgcgacatggcacacaccttgataatgatcgggtccaacgcttcggaccggatgggcatgggggtgacttacctggcccttatcgccaccttcaagatccagccctttctggcgttgggcttcttccttcgcaagctgacgtcccgggaaaacttactcctgggcgttgggctggccatggcgacgaccctgcagctgcccgaagacatcgagcagatggccaacggcatcgcgctcgggctcatggccttaaagctgatcacccagttcgaaacgtaccagctctggaccgctttagtcagcctgacctgcagcaataccatatttactcttaccgttgcctggcgcacggcgaccctgatcctggcgggcgtttccctcctgcccgtctgccagagctccagcatgcggaagacggactggctgccggtggcagtcgctgccatgggggtgccaccgctccccctgttcatcttcagcctgaaagacacgcttaagcgccgctcctggccgctgaatgagggcgtgatggccgtgggcctggtgtcgatcctcgcgtcaagtctgctgcggaacgacgtccccatggccgggcctctcgtcgcagggggactgctcatagcctgctacgttatcaccggaacaagcgccgacctcacggtagagaaagctgccgacgttacctgggaggaggaggcagagcagaccggggtctcccacaatctaatgatcaccgtggacgacgacggaacgatgcgaatcaaggacgatgagaccgagaacatcctgaccgtcctattaaagactgctctgctcatcgtgtctggcatcttcccctactccatacccgctaccctgctggtttggcacacgtggcagaagcagacccagaggagcggagtcctctgggacgtgcccagcccgccagagacccagaaggcggagctggaggaaggcgtgtaccgcattaaacaacagggaatcttcggcaaaacccaggttggggtcggtgttcaaaaggaaggcgtctttcacacaatgtggcatgtgaccaggggggctgtgctaacgcataacggcaagcgcctcgagccgaactgggcctcagtcaagaaggatctgatctcctacggtggtggttggcggctgagcgcccagtggcagaagggcgaagaggtccaagtaatcgcggtcgagcccgggcgaaaccctaagaacttccagaccatgcctgggattttccagacgaccacgggcgagataggtgctatcgcgttagacttcaagcctggcaccagcggctctcccatcatcaatcgggaagggaaggttgtaggcctctacgggaacggcgttgtgacgaagaatgggggctacgtgagcggcatcgcccaagcgaacgcggaacccgacggtccaacccccgagctggaggaggagatgtttaaaaaacgcaatctgaccatcatggacctccaccccggttccggcaagactcggaaatacctgcccgccatcgttcgcgaggccatcaagcggcgcttacggacgttgattctggcgccgacccgcgtggtggcggcggagatggaggaggccttgaaaggcctcccgatccggtaccaaaccactgccaccaagtccgagcataccggcagagaaattgttgacctgatgtgccatgcgaccttcaccatgcggctgctctcgcccgtgcgcgtgcccaactacaatctgatcatcatggacgaggctcattttacggacccggcaagcatcgccgcacggggctacatctccacacgcgtcggtatgggggaagccgctgcgattttcatgaccgccactccgcccggcacggccgaggccttcccgcaaagcaacgccccgatccaggacgaggagcgtgacatccccgagcggagttggaacagcgggaacgagtggatcaccgacttcgtaggaaagactgtgtggttcgtcccctccatcaaggccgggaacgatatcgctaactgcctgcgtaagaacggcaaaaaggtgatacaactcagccggaagaccttcgatactgagtatcagaagaccaagctaaacgattgggacttcgttgtcactaccgacatctccgagatgggggctaacttcaaggccgaccgcgttatcgacccccggcggtgcctgaagccggtgatcttaactgacgggcccgagcgggtaatcttggctggccccatgccggtgaccgccgccagcgcggcccagcgccgggggcgcgtgggccggaacccgcagaaggagaacgaccagtacattttcactggtcagcccctgaacaatgacgaggaccatgcgcactggaccgaggctaagatgctcctggacaacatcaacacccccgagggcataatccccgctcttttcgagccggagcgtgagaagtccgccgcgatcgatggtgagtaccggctgaagggggagagccgcaagaccttcgtcgagttaatgagacgcggcgacctccccgtgtggctcgcccataaggtcgcctctgagggtatcaagtacaccgatcgaaagtggtgcttcgacggcgagcgcaataaccagatcttagaggagaacatggacgtcgaaatctggaccaaagaaggcgagcgaaagaaattgcgcccacgctggctcgacgcgcggacctacagcaatccgctggccttgaaagagttcaaggacttcgcggctgggcgcaagagcatcgcactcgacctggtgacagaaatcggccgggtcccgagccacctggcccaccgcaccaggaacgctctagacaacttagtcatgctgcacaccagtgagcatggagggcgcgcataccgacacgccgttgaggagctccccgagaccatggaaacgctcctgctcctggggctgatgatactcctaacgggcggcgccatgctctttctcatctccgggaagggcatcgggaagacctccatcggactgatctgtgtcatcgtgtcaagcggcatgctctggatggcggatgtacccctccagtggattgccagcgcgatcgtgctggagttcttcatgatggtgctgctaatcccggagcccgaaaagcagaggacgccccaggataaccagctggcctacgtcgtcatagggatccttacgctcgccgccatcgtcgcagcgaatgagatgggcctgctggagactaccaagcgggaccttgggatgtctaaggagcccggcgttgtctcccccaccagctacctggacgtggatctgcaccccgccagtgcatggactctctacgcagtcgcgacaaccgtcattacccccatgttgcgccatacgatcgagaacagcaccgcgaacgtcagtctggccgccatagcgaaccaagccgtggtcttaatgggcttagacaaggggtggcccatcagcaaaatggatctgggggtaccgttactggcactgggctgctacagtcaggtcaaccccctcacattgaccgccgccgtactgctcctggtaacgcactacgccattatcggccccggcttgcaggctaaggccacccgggaggcacagaagcgaaccgccgccggtatcatgaagaacccgaccgtcgacgggatcatgacgatcgatctcgaccccgtcatctacgatagtaagtttgagaaacagcttggacaggtgatgctcctcgtgctgtgtgcggtccagctgctactgatgcggacttcctgggcgctgtgtgaagccttaaccctggcgacaggccccattacgaccctgtgggaggggagccccgggaagttctggaacaccaccattgcggtgtccatggccaacatcttccgtgggtcgtacttggcaggcgccgggctggccttctccatcatgaagtccgtgggcacgggcaagcggggaacaggttcccagggggagaccctgggcgagaagtggaaaaagaagctcaaccagttaagccgccgggagttcgagctgtataagaaatccggtatcaccgaggtcgaccgtacggaggctaaggagggcctcaaacggggcgagaccacccaccacgccgtgtcccgcggatctgccaagttgcagtggttcgtggagcgaaacatggtcattcctgagggccgcgtcatagatctggggtgcggacgcgggggctggtcctattactgcgccggcctaaaaaaggtgaccgaggttcggggttacaccaagggtgggccgggccacgaagagcccgtgcccatgagcacttacggctggaacaccgtgaagttgatgtccggtaaagacgtcttctacctgcccccggagaaatgtgacaccctgctatgcgatatcggcgagtctagcccctcgcccaccgtggaggaatcccgcaccataagagtgctcaaaatggtcgagccctggctgaaaaacaatcagttctgcatcaaggtgctcaacccgtacatgcccaccgtgatcgagcacctggaacgcctgcaacggaaacacgggggcatgctcgtgcggaaccccctcagccgaaactccacccacgaaatgtactggataagcaacgggaccggcaatatcgtgtccagcgtcaacatggtctccaggctgctgctgaaccgatttacgatgacccacagaaggcctaccatagaaaaggacgtagacctcggcgccggtaccaggcacgtaaatgcggagcctgaaacgccgaacatggacgtaattggcgagcggattaagcgcatcaaggaggagcacagcagtacctggcattacgatgacgagaacccctacaaaacctgggcctaccacgggagctacgaggtgaaggccaccgggtccgccagctcaatgataaacggagtggtgaagctcctgacgaagccgtgggacgtggtcccaatggtgacccagatggccatgaccgacaccacgccctttggccagcagcgagtgttcaaggagaaggtcgacacccgcacgccgcggcccatgccgggcacccgcaaggtgatggagatcaccgcggagtggctttggcggaccctgggccggaacaaacgccctcggctgtgcaccagagaggagtttaccaagaaggttcggacgaacgcggccatgggcgccgtcttcaccgaggaaaaccaatgggagtccgcgagggccgccgtggaggacgaggagttctggaagctggtggggcgggagcgcgaactacataagctggggaagtgcgggagctgtgtctacaacatgatgggaaagcgtgagaagaagctgggcgagttcgggaaggccaaggggtcacgtgccatctggtacatgtggctcggtgcgcggtacctggaattcgaggctctaggcttcctcaacgaggatcactggttcagccgcgagaacagctactcaggggtggagggcgagggcctgcacaaactggggtacatcctccgggacatctctaagatcccaggcggcgccatgtacgcggacgacacagctgggtgggacactcgcatcacagaggacgacttacacaacgaggagaaaatcacccagcagatggacccggagcaccggcaactggcaaacgccattttcaaactcacctaccagaacaaggtggtcaaggtgcaacggcctacccccaaaggaacggtgatggacatcatctcacggaaggatcagcgcgggagcggtcaggtgggcacctacggcctgaacaccttcaccaatatggaagcccagttaatccggcagatggaaggcgagggcgtgctctcaaaggccgacctggagaaccctcatctcctagagaagaagatcacacagtggctcgagacgaagggagttgagcgactgaaaagaatggcaatctccggggacgactgtgtcgttaagcccatagatgatcgcttcgctaatgccctccttgccttaaacgacatgggaaaggtgcggaaagacatcccccagtggcagccctccaaggggtggcacgactggcagcaagtccccttctgctcccatcacttccatgagctcataatgaaggatggtcgtaaactggtggtgccttgtcgcccccaggacgagctgatcgggcgggcgcgcatcagccagggtgccgggtggtcattaaaggaaactgcgtgcctaggtaaggcgtacgcgcaaatgtggtcattgatgtacttccatcggcgcgacctccgactggcaagtaacgcgatttgcagcgccgtccccgtgcactgggtgcccacctcgcgcacgacgtggagcatacacgcccatcaccaatggatgaccaccgaggatatgctaactgtctggaacagagtgtggatcgaggataacccctggatggaggacaagacgcccgtaaccacatgggaggacgtgccctacctcggaaaacgtgaggaccagtggtgcgggtcgttaatcggcctgacatcccgggccacgtgggcccagaacatcctcaccgcgattcagcaggttcgcagcctgattggggacgaggagtttttggactacatgcccagtatgaagcggttccgcaaggaggaggagagtgagggcgccatatggtga

SEQ ID NO: 26143 - RNA, 9873 nt, synthetic construct
  misc_feature 1..9873: note = derived and/or modified CDS sequence (opt11) from DENV-3__KJ622198__SS-prME
  source 1..9873: mol_type = other RNA
accagcctgtgtctcatgatgatgcttcccgccaccttggccttccacctcacaagccgggacggcgaaccccggatgatcgtagggaaaaacgagcggggcaagtcactgctgttcaagactgcgagcgggattaacatgtgcactctcatagccatggacctgggcgagatgtgcgacgacaccgttacctacaagtgcccccttatcgccgaagttgaacccgaggacatagactgctggtgcaatctcacctccacttgggtgacgtacgggacgtgcaaccaggccggcgagcaccggcgcgacaaacggtccgtcgccctcgcgccacacgttggcatggggctggacacccgcacccagacctggatgagcgccgaaggcgcctggcgacaggtggagaaggtcgagacgtgggcgttgcgccaccccgggttcaccatactggcgctgttcctcgcccactacatcggcacctccctgacccagaaggtcgtgatcttcatcctgctcatgctggtaacgcccagtatggccatgagatgcgtgggggtaggcaatcgcgacttcgtcgaggggctctccggggccacctgggtagatgtggtactcgagcacggcggctgcgtaacgactatggccaagaacaagcccaccctggacatcgaactgcagaagaccgaagcaacccagctcgccacgctccgtaaactgtgcatcgagggcaagatcaccaatataactacagatagccggtgtcccacccagggcgaagccatccttcctgaggaacaggaccagaactacgtgtgcaaacacacgtacgtagaccgcggatggggcaacggctgcggcctgttcggtaagggttccctggtaacctgcgccaagttccagtgcctggagtcaatcgaaggcaaggtggtccagcacgaaaacctgaagtacaccgtgacaatcacggtgcacaccggggaccagcaccaggtgggcaatgatacgcagggcgtgaccgccgagatcacgccccaggcgtccaccgtcgaggctatcttgcccgagtacggcacgctcggtctagagtgctctccccgcaccggcctggacttcaacgagatgatcctcttgaccatgaagaacaaggcctggatggtacaccgtcagtggtttttcgacttaccactcccctggacgagtggagccatcaccgagacccccacgtggaaccgcaaggaactgctggtgacgttcaagaacgcgcatgctaagaagcaagaagtcgtggtgctcgggagccaggagggcgccatgcacaccgccctgaccggagccactgagatccaaaattccggagggactagcatcttcgccggccacttaaagtgccggctaaagatggacaagctggagctgaagggcatgtcctacgcgatgtgtctaaacaccttcgtcctgaagaaggaggtgagcgagacccagcacgggacgatactgatcaaagtggagtacaaaggtgaagacgcaccctgcaagatcccattcagcacggaggacggccagggaaaggcccataacggccgccttatcaccgccaacccggtggtgaccaagaaggaggagcccgtcaacatcgaagcggagccgccgtttggcgagtccaacatcgtcatcggcatcggggataaggcactcaagatcaactggtacaagaagggctcatcaatcgggaagatgttcgaagcgacggccagaggcgctcgccggatggcgattctgggagacaccgcctgggacttcgggagcgtgggcggggtgctgaactccctcggaaagatggttcaccagatcttcgggtctgcctatactgccctgttcggaggcgtgtcctggataatgaagatcgggatcggcgtgctgttgacctggatcggtcttaactctaagaacacctcgatgagcttctcctgtatcgtcatcggcatcatcacgctttaccttgggaccgtcgtgcaggccgacatgggttgcgtaataaactggaagggcaaggagctgaaatgcgggagcggcatattcgtgaccaacgaagtccacacctggacggagcagtataagttccaggcggacagtccgaagagattagccaccgccatcgccggtgcatgggaaaacggcgtctgtggcatccgcagcacaacccggatggagaacctcctgtggaagcagatcgcgaacgagcttaactacatcctctgggagaacaacattaagctgacagtagtggtcggcgacatcatcggcgtactggagcaggggaagcgcaccctcacaccacaacccatggaattaaagtattcctggaagacctggggcaaggccaagatcgtgacggccgaaattcagaacagctccttcatcatcgacggtccgaacacccccgaatgccccagcgcttcccgggcgtggaacgtctgggaggtggaggattacgggttcggcgtgttcaccaccaacatctggctgaagctccgcgaagtctacacgcagacctgcgaccaccggcttatgagcgcagctatcaaggacgagagagcagtgcatgccgacatgggatactggattgaaagccagaagaatggctcctggaagctggagaaagcgagcttcatcgaggtcaagacctgcacgtggcctaagagtcacactttgtggagcaacggggtcttagagtccgacatgatcattccaaaaagcctggccggcccaatctcccagcacaatcaccggcctgggtatcacacgcagactgcaggcccgtggcatctcggcaagctggaactggatttcaactattgcgaggggaccacagtggtaatcacggagaactgcggcacccgcggccccagtctccggaccaccactgtctccggtaagctgattcacgagtggtgctgtcgctcttgcaccctgccgcccctccggtatatgggggaggacggctgctggtatggaatggagatacgcccgatcaacgagaaggaggaaaatatggtaaagtccctagtaagcgccgggtccggcaaagtcgacaacttcaccatgggggtgctgtgcctagccattctgttcgaggaagttatgcgtggtaaattcgggaagaaacacatgatcgcaggcgtcctgcttacctttatgctgttgctcagcggccagatcacgtggcgggacatggcccacaccctgatcatgatcgggtccaacgccagtgaccggatgggcatgggcgttacttacttggccctcatcgcgaccttcaagatccagccctttctggcgctgggcttctttctccgtaagctgacgtctagggagaacctgctgctgggcgtgggcctggcgatggccaccaccctccagctgcctgaagacatcgagcagatggccaacggcatcgcactgggcctcatggccctgaaactgatcacgcagtttgaaacataccagttgtggaccgccctggtcagcctgacctgcagcaacacgatcttcacgctcaccgtggcttggcgcaccgccaccctgatcctggcgggcgttagtctcctgcctgtctgccaaagctctagcatgcgtaaaacggactggctgcctgtggccgtcgccgccatgggcgttccgcccctgcctctgttcatcttcagtctgaaggacaccctcaagcgccgctcgtggccgttaaatgaaggcgtcatggccgtcggcctggtttccatcctcgcgtcatccctgttgcgtaacgacgtgcccatggccgggcccctagtggccggcgggctgctgatcgcctgctacgttatcacaggcactagcgcagacctcacagtggagaaggcggccgacgtcacctgggaggaagaagccgagcagactggggtgtctcacaacctaatgatcacagtggacgacgacggtacgatgcgaatcaaggacgatgaaaccgaaaacattctgactgtcctgctgaaaaccgcccttctcatcgtgagcggtatcttcccttactccatcccggcgaccctgttagtgtggcacacatggcagaagcagacccagcggagcggggtactatgggacgtgcccagcccgcccgagacacagaaagctgagctggaggagggcgtgtaccgcataaagcaacaaggaatcttcggcaagacccaggtcggggtgggggtgcagaaggaaggcgtcttccacacgatgtggcacgtgacccgcggggccgtcttgactcacaacggcaagcgcctcgagccgaactgggccagcgtgaagaaagatctgatttcctacgggggcgggtggcggctgagcgcccagtggcagaagggcgaggaggtccaggtaattgcggtcgagcccgggcgcaaccccaaaaacttccagaccatgccggggatattccagacgaccaccggcgagatcggggctatagctctggattttaagccgggaacctccggctcccccataatcaaccgtgaagggaaggtggtaggcctctacgggaatggcgtcgttacaaagaacgggggatacgtgtcaggcatagcgcaggccaatgcggagcccgacgggccgacgcccgagctggaagaggagatgttcaaaaagcgcaacctgacaatcatggacctccacccgggcagcgggaagacacggaagtacctacccgccatcgtccgggaggcgatcaaacggcgtttacggacgctcattttggcaccgaccagagtggtggccgcggaaatggaggaggcactgaagggcctccccatccggtaccagaccaccgcaactaaatccgagcacacagggcgcgagatcgtcgacctgatgtgccacgctactttcaccatgcggctgctatcccccgtgcgcgtcccaaactacaacttgatcatcatggacgaggcccacttcacggacccggcgagtatcgccgcgagaggctacatctccacccgcgtcggcatgggggaggccgcggccatctttatgacggctacgccacccggcacggccgaggccttccctcagagcaatgcgcctatacaggacgaggagcgcgacatccccgaacggtcctggaactccgggaacgagtggatcaccgacttcgtgggtaagaccgtgtggttcgtcccctccatcaaagccgggaacgacatcgctaattgtctgcgcaagaacggcaagaaggtgatccaactctcacggaagacgtttgacacggagtatcagaaaacaaagctgaacgactgggacttcgtggtcactaccgacatctccgagatgggcgccaacttcaaggccgaccgcgtgatcgacccccggcgctgcctgaagcctgtgatcctcacggatgggcctgaacgcgtcatcctggcgggcccaatgcccgtgaccgccgccagcgccgcccagcgccgggggagagtcggtcggaacccgcagaaagagaacgaccagtacatattcaccgggcagcccctcaataacgacgaggatcacgcgcactggaccgaggccaagatgctcctggacaacattaatacgcccgagggcattatccccgccctgttcgagccggagcgcgagaagagtgccgcgatcgatggcgagtaccggctcaagggggagtcgaggaagacctttgtagagctgatgcggcgcggcgacctgcccgtgtggctcgcccacaaagtcgcttccgaagggatcaagtacaccgatcggaagtggtgcttcgatggcgagcgcaataaccaaattctggaggagaacatggacgttgaaatttggaccaaggagggggagcggaagaaacttcgccccagatggctcgacgcccggacctactcgaacccgctggcccttaaagagttcaaagatttcgcggcggggcgcaagtccatcgcgctcgaccttgtgacggaaataggccgggtcccgagccacctcgcccaccgtacccggaacgctctcgacaaccttgttatgctgcacacctccgagcacgggggccgcgcgtatcgccacgccgttgaggagctccccgagaccatggagacgctactcctcctaggactgatgatactcctgaccggcggagcaatgctattcctcattagcgggaagggcatcgggaagacctctatcggcctgatctgcgtcattgtgtcgtctgggatgctgtggatggccgacgtgcccttgcagtggatcgcctccgcaatcgtcctggagttcttcatgatggtgctcctgatcccggagcccgagaagcagcgcacaccccaggacaaccagctggcctacgtcgtcatcggcatcctgacgctcgcagccatcgtagccgcgaacgagatgggcttgctggagaccaccaaacgggacctcgggatgtcgaaagagcccggtgtggtctccccgaccagctatctggacgtggacctgcaccccgcctccgcctggacgctctatgcggtggcgactaccgtcatcacccccatgctgcgccacacgattgagaacagcacagccaacgtgtccctggccgcgatcgccaaccaggcggtggtcctcatggggttggacaagggctggcccattagcaaaatggaccttggcgtgccgttactggcactaggctgctactcccaggtgaacccactcaccctgaccgccgctgtcctcctactggtgacccactacgccatcatcggtcccgggttacaggccaaagccacccgggaagcccagaaaagaaccgcagcaggcatcatgaagaaccccacagtggacgggataatgacgatcgacttagacccggtcatctacgacagcaagtttgagaaacagctgggacaggtgatgctgctcgtgctgtgcgcggtccagctgctgctgatgcgaacctcttgggcactgtgcgaggccctcaccctggccaccggccccatcacaaccctgtgggagggctcacccggcaagttctggaacaccaccatcgcggtgtccatggccaacatcttccgcgggagctacctcgccggcgccgggctggccttctccatcatgaagtccgtgggcacaggcaagcgggggaccggctcccagggggagaccctgggggagaaatggaagaagaaactcaatcagctgtcgcgccgggagttcgagctgtacaagaaaagcgggatcacggaggtcgaccgcacagaggcgaaggagggcctgaagcgtggcgagaccactcaccacgcagtgagccggggaagcgccaaattgcagtggttcgtggagcggaacatggtaatccccgaggggcgcgtgatcgacctggggtgtggccgcgggggctggagttactactgtgccggactcaaaaaggttacagaggtgcgggggtacacaaagggcgggccaggacacgaggagcccgtgccaatgagtacatacggttggaacaccgtgaagctaatgtccggaaaggatgtcttctacctgcccccagagaaatgcgacaccctgctctgtgacattggagagagcctcccctcccccaccgttgaggagagccgcactatccgggtgttgaagatggtcgagccctggctcaagaacaatcagttttgcatcaaggtattaaacccgtacatgcccacagtgatcgagcacctggagcgcttgcagcgtaagcacgggggcatgctggtccgaaaccctctgtcccgtaactctacccatgagatgtattggatctccaacggcacaggcaacatcgtgtcatccgtgaatatggtcagccgcttactgctgaaccggttcacgatgacccaccgccggcccaccatcgagaaggacgttgacctcggcgccgggacccgccacgtcaacgcggaaccggagactcccaacatggatgtgatcggcgaacggatcaagcgcattaaggaggaacactcctcaacctggcattacgacgacgagaatccgtacaagacctgggcctatcacgggtcctacgaggtgaaggccaccggctccgcctccagcatgattaacggggtagtgaagttgctgaccaagccatgggacgtggtccccatggtgacccagatggccatgacagacaccacgccctttggccagcagcgggtgttcaaagaaaaagtcgacaccagaactcctcggccgatgcccggcacccgtaaggtgatggagatcacggcggagtggctctggcgtaccctgggacgcaataaacgccctcggctgtgcacccgcgaggagttcaccaagaaagtgcggacaaacgccgccatgggcgccgtgttcaccgaggagaaccagtgggaaagtgcccgcgccgccgtggaggacgaggagttttggaagctagtggggcgggaacgcgagctgcacaaactgggcaagtgcgggtcctgcgtctacaacatgatgggcaagcgggagaagaagctcggagagttcgggaaggccaagggcagccgcgcaatctggtatatgtggctaggggcgagataccttgagtttgaagccctcggcttcctgaacgaggaccactggttctccagggagaactcatactccggggtcgagggcgaaggcttacacaagctcggatacatcctgcgggacatctcaaagatccctggcggcgctatgtacgccgacgacaccgccggctgggacacccgaatcacggaggacgacttacacaatgaggagaaaattacccagcagatggacccggagcaccggcagctagcgaatgccatcttcaaacttacctaccagaacaaggtggttaaggtgcagcgacccacacccaagggcaccgtgatggatatcatcagccggaaggaccagcgcgggagcgggcaggtcgggacgtacggattgaacaccttcaccaacatggaggcccagttaatcaggcaaatggagggggaaggcgtgctgtccaaggcggacctggagaaccctcacctgttagagaagaagataacccagtggctagagacgaaaggagtggaacgcctcaagagaatggccataagcggggacgactgtgtcgttaagcccatcgatgaccgattcgcgaacgccctccttgccctcaacgacatgggcaaggtccggaaggatataccgcagtggcagccctccaaaggttggcatgactggcagcaggttcccttctgcagccaccacttccacgagctgattatgaaggatggtcgcaagctagtggtgccatgtaggccccaggacgagttgatagggcgggccagaatctcccagggtgcaggctggagcctgaaggagactgcgtgcctgggcaaggcctacgcccagatgtggagtctaatgtacttccaccggcgcgacctgcggctggccagcaacgcgatatgctccgcagtccccgtccactgggtgcccacaagccgcaccacgtggtccatccatgcccaccaccagtggatgaccaccgaagacatgctgaccgtctggaaccgggtgtggatcgaagacaacccgtggatggaggacaagacgcccgtgacgacctgggaggacgtcccctatctgggcaagagggaggaccagtggtgcgggagcctgatcggcctcactagccgggcgacgtgggcccagaatattctgaccgcgatccagcaggtccgctcgctgatcggggacgaagagttcctcgactacatgcccagtatgaagcggttccggaaggaagaggagagtgaaggcgccatctggtga

SEQ ID NO: 26144 - RNA, 9873 nt, synthetic construct
  misc_feature 1..9873: note = derived and/or modified CDS sequence (opt11) from DENV-3__KJ622191__SS-prME
  source 1..9873: mol_type = other RNA
acatcgctttgcctcatgatgatgctaccggccacgcttgcattccacctcacctcgagagatggggaaccgagaatgatcgtcgggaaaaacgaacgtgggaaatccctactattcaaaacagccagcggcattaacatgtgcaccctaattgcaatggacctaggcgaaatgtgcgatgacacagtgacgtacaaatgtcccctaatcgccgaagtggaacccgaagatattgactgttggtgcaacctgacgtccacgtgggttacgtacggaacatgcaatcaagccggagaacatagaagggacaaaagatccgtcgcgctagcaccgcacgtagggatgggactagacactaggacccagacatggatgtcagccgaaggggcctggaggcaagtcgagaaagttgagacatgggccctccgacaccccggattcactatcttagcactcttccttgcccactacatcgggacaagcctaacccaaaaagtagttatcttcatcctcctcatgcttgtaaccccaagcatggccatgcgatgcgtaggcgtcggaaaccgcgactttgttgaaggactaagcggcgccacatgggtagacgttgtactagaacatgggggctgcgtcaccactatggccaaaaacaaacccaccctggacatcgaactccagaaaaccgaggcaacccaactagccactttacggaaattatgcatcgagggaaaaatcacgaacatcaccacagactcacggtgcccgactcaaggagaggcaatcctaccagaagaacaggaccagaactacgtatgcaaacatacttacgtagaccggggttggggaaacggatgcggtttgtttggcaaaggaagcctggtaacctgcgcgaaatttcaatgcctcgaatcgatagagggcaaagtcgtgcaacacgaaaacctcaaatacacggtgactataacagtacacacaggcgaccaacaccaagtaggaaacgatacacagggagtcacagcagagatcaccccacaagccagcacagtcgaggcgatattacctgaatacgggacgctaggcctggagtgtagtccccgcacaggactcgactttaacgaagtcattctgctcaccatgaaaaacaaagcctggatggtacaccgtcagtggttctttgacttgcccttaccctggacgtccggagccatcacagagacacccacatggaaccggaaagaactactggtaacctttaaaaatgcccacgcgaagaaacaagaagtagtagtgctggggtcgcaggaaggcgccatgcataccgctcttaccggcgccaccgagatccagaacagcggaggaaccagcatatttgcaggccacctaaaatgccgactcaaaatggataaattggaattgaaaggcatgtcatatgccatgtgtctgaacaccttcgtgctaaagaaagaggtgagcgaaacccagcacggtaccatcctcatcaaagtcgagtacaaaggcgaggacgccccatgtaaaataccattctcaaccgaggacggacaaggaaaagcccacaacggacgacttatcacggcgaatccggttgtcacaaagaaagaggaaccagtcaatatagaggccgaacccccattcggcgaatcgaacatagtcataggcatcggggacaaagctcttaaaatcaactggtataagaagggtagttcgatagggaaaatgttcgaagcgacagcgagaggggcacgacgaatggccatcctcggcgataccgcctgggacttcggctcagtcgggggcgtgctcaactcactaggcaagatggtgcaccagatattcggcagtgcgtacacagcactgttcggcggcgtatcttggataatgaaaatagggataggggttctattgacatggatcggcctgaatagtaaaaacacgtccatgtcttttagctgcatagtcataggcatcataaccctgtacctaggaacagtagtccaggccgacatgggctgtgtcatcaactggaaaggtaaagagcttaaatgtggttcagggattttcgttactaacgaagtccacacctggaccgaacagtacaaattccaagccgacagcccaaaacgactcgccacggcaatagcgggggcgtgggaaaacggagtgtgcggaataagatctacaacgagaatggagaacctgctgtggaagcagatagcaaacgaactcaactacatcctatgggagaacaatatcaagctcacagtggtcgtaggggacatcatcggagtgttagagcaaggcaaaaggaccctaactccccaaccgatggagctgaagtacagctggaaaacttggggaaaggcaaaaatagtgaccgcagagatccaaaacagcagtttcatcatagacggcccaaataccccagaatgcccaagtgcttcacgtgcatggaacgtctgggaggtagaagactacgggtttggagttttcaccacgaacatctggctaaaactccgagaagtctacacacagacgtgcgaccaccggctcatgagcgccgcgattaaagacgaacgcgctgtccacgcagacatgggatactggatcgaaagtcagaaaaacggtagctggaagctcgaaaaggcatccttcatcgaggtaaaaacttgtacatggccgaaaagccacaccctctggagcaacggggtgctcgagagtgacatgatcatcccgaagtcgcttgcaggcccgataagtcagcacaatcaccgccccggctaccatacccaaacggcgggcccatggcacttaggtaagctcgaattggattttaattactgcgagggaaccaccgttgtaatcaccgaaaactgcggaaccagagggccatcactccgcacgactacagtgtcagggaaactaatacacgaatggtgctgccgaagttgcacgctaccacccttgcgctacatgggtgaagatggctgctggtatggaatggagattcgaccaatcaacgagaaggaagagaacatggtgaaatccttagtttccgcaggaagcggtaaagtagacaacttcaccatgggagtgctttgtctggcaatattattcgaagaagtgatgaggggaaagttcggcaagaaacatatgatcgccggagttctacttacgtttatgctactgttatcaggccaaattacgtggagagatatggcccacaccctaatcatgataggatctaacgccagtgatagaatgggcatgggagtcacatacctcgccctgatcgctacctttaaaatccaaccattcctagccttgggtttcttccttaggaaactcaccagtagagagaacttgctgctcggagtgggtctcgccatggcaacaaccctccaacttccagaagatattgaacagatggcgaacggtattgctttagggctgatggcccttaaactgatcacgcagttcgagacatatcagttatggacagcacttgtctccttgacatgcagcaacactatattcacacttaccgtcgcatggcgaacagccacactgatattagcgggagtgagcctattacccgtgtgccaaagtagcagcatgcgcaaaactgactggttgccagtcgctgtagctgcaatgggagtgccacccctaccactctttatcttcagcctaaaagacactctaaaacgtaggagctggcccctcaacgaaggggtgatggccgtggggcttgtgagcatactggcctcatcgctcctacgcaacgacgtacccatggcggggccgctggtcgcgggtggactgctaattgcctgctacgtgattacaggaacaagcgctgacttgactgtcgagaaggcggccgacgtcacgtgggaagaggaagccgagcaaacgggagtatctcacaacttaatgatcaccgtagatgacgatggaacgatgcgaataaaggacgacgagaccgaaaacattctcacagtcctgctcaaaacagcgctcctcatcgtctcagggatattcccatacagtatacccgcgacccttttggtgtggcatacgtggcaaaaacagacacagcgttccggcgtcctctgggacgtgcccagcccgcccgaaacacaaaaagcggaattagaggaaggcgtgtaccgtatcaaacagcaaggaatattcgggaaaacccaagtgggcgtaggcgtgcagaaagaaggcgttttccatacaatgtggcacgtaacacggggagcagtattgactcacaacggaaaacggctcgaacccaactgggcctccgttaagaaagacctcattagctatgggggcggatggcgactgagtgcacagtggcagaagggggaggaagtccaagttatcgcggtggagcccggccgaaaccccaaaaacttccaaacgatgcctgggatcttccagacgaccatgggagaaatcggcgcgatagcgcttgacttcaagcccggtacctcaggttccccaatcattaatcgggaaggaaaagtagtggggctgtacggcaacggcgtcgtaaccaagaacggagggtacgtcagcgggatcgcgcaagccaacgcggaaccagatgggccgacaccagaactagaggaggaaatgtttaaaaagagaaatctgaccattatggatctacaccccggaagcggcaagacccgaaagtatctaccagcaatcgtccgagaagccataaagcgcaggctaagaacgctaatactcgcaccgacaagggtggtcgcggcggaaatggaagaggcgcttaagggcctcccgattagataccaaactaccgcgacaaagtccgagcacaccggaagggagatagtagacttaatgtgccacgccactttcaccatgcgtctcttgagtcccgtacgcgtgccgaattacaatttgatcataatggacgaagcacactttacggatccagcgtcgatagcggcccgcggttacatcagcacccgagtcggaatgggcgaagcggcggcgatttttatgacggcaacgccaccagggacggcagaagcatttccccaaagcaacgcccccattcaagacgaagaacgagatattccggagcgctcttggaactcggggaatgagtggataacagacttcgtgggaaaaacagtttggttcgtaccctcaataaaagccggtaacgacatagccaactgcctgcgcaaaaatggaaagaaagtgatacagctctcaaggaaaacattcgacaccgagtatcagaagacgaaattaaatgattgggacttcgtcgtcactacagatatctcggaaatgggcgcaaacttcaaagcggaccgcgtgatcgacccaagaaggtgcctaaaacccgtaattctcaccgacggacccgaaagagtcatacttgccggacctatgccagtgaccgcagcaagtgccgcccaacggaggggcagagtcggaagaaacccccagaaagaaaacgatcagtatatattcaccggccaaccgctgaacaacgatgaggaccacgcgcattggacagaagcaaagatgctcctcgacaacatcaacaccccagaaggaataatcccggccctattcgagccagaacgtgagaaaagtgcggccattgacggtgaatatcggctaaaaggggaaagccggaaaactttcgtagagctaatgagaagaggcgaccttcccgtatggctcgcacacaaggtggccagcgaaggaataaaatacactgacagaaaatggtgttttgacggagagcgaaataaccagatactagaagaaaatatggacgttgagatatggacaaaagaaggagagcggaagaaattgcgaccacgatggctagacgcacgaacatacagcgacccactagcactaaaagaatttaaggacttcgccgcaggccgtaaatcgatagccctagacctcgtgacagaaatcggccgtgtaccgtcgcatctcgcccatagaacaagaaacgcacttgacaacctagtgatgctccacacgtcagaacacgggggcagagcataccgacacgcggtcgaagaacttccagaaaccatggaaaccctccttctgctaggactaatgatcctgctaacaggaggcgccatgctattcttaatctcaggcaaaggtataggcaaaaccagcatcgggcttatatgcgtcatagtaagtagtggtatgttatggatggccgatgtcccgcttcagtggatagcgtcggccatagtcttggagttcttcatgatggtcctactaatccccgaaccagaaaagcagagaacgccacaagacaaccaactagcttacgttgtaatcggaatcctaactctcgccgccattgtcgccgcaaacgagatggggcttctggagacaaccaaacgcgacttaggaatgagtaaagagcctggcgtggtttcccctacctcgtaccttgatgtggacctccaccccgccagcgcgtggacgctgtacgccgtagcaacgaccgtcatcacgcccatgctaagacatacaatagaaaactccacagcgaacgtgtcactagccgcaatcgcaaatcaagcggtcgtactaatgggccttgacaaagggtggcctatctcaaagatggacctcggcgtcccgctattagcactagggtgctactcgcaagtcaacccactaaccctaacggcggccgttctccttctagtcacgcactacgccatcataggacctggcctgcaggccaaagctacgcgtgaagcgcagaaacggaccgcggcaggtatcatgaaaaaccccacagtcgacggcatcatgacaatagacctcgacccagtcatttatgactcgaagttcgagaaacagctaggccaagttatgctcctcgtcctctgtgcagtccaactgctcctaatgcgaacaagctgggccctatgcgaggccctgacactagcaacagggcccatcactacactttgggaaggcagtccgggcaagttttggaacacaacaatagcagtgtctatggcgaacattttccgcggaagctacctggcgggtgcagggctagcattcagcataatgaaatccgtaggaaccggaaaacgagggaccggcagccagggcgagaccctcggtgagaagtggaagaagaaactgaaccagctcagcagacgagaatttgaactgtacaagaaatcaggaatcaccgaagtcgacaggacagaagcaaaagaaggattgaaacgaggggagacaacccaccacgcggtcagcagaggaagtgcaaaactccagtggttcgtagaaaggaacatggtaatccccgagggccgcgtaatcgatttaggttgtggacgcggaggatggagctactactgcgcaggcctgaagaaagttacggaagttagaggctacaccaaaggagggcccggccacgaagaaccggtaccgatgtctacatatggatggaacaccgtcaaactgatgtccggtaaggacgtattctacctaccacccgaaaaatgcgatacgctattatgtgatataggagagtcttccccgtcgcccaccgtagaagaaagccgcacgatacgggtactgaaaatggtcgaaccatggctcaagaacaatcaattctgcataaaagtgctaaacccctacatgcctacggtcatcgaacacctagaacggctacagagaaagcacggcggcatgttagtacggaatcctttaagtagaaattccacacacgaaatgtactggataagtaacggcacaggaaatatagtcagtagcgtgaatatggtttcgcgcctcctactcaaccgctttacaatgacacaccgacgaccgacaatcgaaaaagacgtggacctcggtgccggaacacgtcacgtaaatgcggagccagaaaccccaaacatggacgttattggagagaggattaaacgcataaaggaagaacactcatccacctggcattacgatgatgagaatccctacaagacatgggcgtaccatgggtcttacgaggtgaaagccacaggttccgcatccagcatgatcaacggagtcgtgaaactactgaccaaaccctgggacgtggtcccaatggtcacgcagatggcaatgacagacaccacaccattcggacaacaacgtgtattcaaagagaaggtagacacccggactcctcgccccatgccggggactcgaaaggtaatggagataaccgcagaatggctctggagaactctgggaagaaacaaacggcccagactatgtacacgcgaggagttcacgaaaaaggttagaacaaatgctgccatgggggcggtcttcaccgaagaaaaccagtgggagagcgcgagggccgccgtggaagacgaggagttctggaagctagtggggcgggagagagagctccacaaactaggaaagtgcgggtcatgcgtctataacatgatggggaaacgcgagaagaaattaggagagttcggtaaagcgaaagggtctcgcgccatttggtacatgtggctaggcgctcgctacctagagttcgaagcactagggtttctaaacgaagaccactggttcagccgggagaacagttacagcggagtagagggggagggattgcacaagctcggatacatattaagagacatctccaaaatacccggaggcgccatgtacgccgacgacacagcaggatgggacacgaggatcacggaagatgatttacacaatgaggagaagatcacccagcagatggaccccgaacaccggcagctggccaacgccatcttcaagctcacgtatcagaataaagtagtcaaggtccaacgacccactccgaaaggaactgtaatggacataatatccagaaaagaccaacgaggatcagggcaagtcggcacgtacggactcaacactttcaccaacatggaagcccagcttataaggcagatggaaggcgagggggtgctatcgaaagccgacctggaaaatccacatttactggagaagaaaatcacccagtggctcgaaaccaagggcgtagaacgattaaaacgcatggcgatcagtggagatgactgtgttgtaaaacccatagatgacaggtttgcgaacgcactcttagcgttaaatgatatgggcaaggtgagaaaggacataccgcaatggcaaccatcaaagggatggcacgattggcaacaggtcccgttctgcagccaccactttcacgaactcattatgaaagacggcaggaagctggtggtgccctgtaggccgcaggatgagctcataggcagagccagaatctcccagggcgccggatggagcctaaaagaaacagcatgcctaggaaaggcctacgcacaaatgtggagcctaatgtactttcaccgccgcgatctccgccttgccagcaacgctatctgcagtgcggtgccggtgcactgggtaccgacctcccgtacgacgtggagtattcacgcgcaccaccaatggatgaccaccgaggacatgctgactgtgtggaaccgggtttggatagaagataacccgtggatggaagataagaccccagtcacaacatgggaggacgtcccttacctaggaaagcgcgaggatcaatggtgcggtagcttaatcggactgacaagtagagcaacctgggcccagaacatattaactgcgatccaacaagttcggtcattgatcggagacgaggagttcctcgactacatgccctctatgaagcgcttccgcaaagaagaggagagtgagggagcgatatggtaa

SEQ ID NO: 26145 - RNA, 9873 nt, synthetic construct
  misc_feature 1..9873: note = derived and/or modified CDS sequence (opt11) from DENV-3__KJ622192__SS-prME
  source 1..9873: mol_type = other RNA
acaagcctgtgcctgatgatgatgctgccagcaacgctggcgttccaccttacctcacgagacggtgaacctagaatgatcgtaggtaaaaacgaacggggtaaatcacttctattcaaaaccgcgtcaggcataaacatgtgcactcttatcgccatggacctaggcgaaatgtgcgacgacacagtaacgtacaaatgccccctgatcgcagaagtcgaacctgaagacatcgattgctggtgtaacttgacatccacatgggtaacgtacggcacatgcaatcaagctggcgaacatcgccgggacaaaagatcagtggcgctcgcgccacatgtcggcatgggcttagacaccagaacacaaacatggatgagcgccgaaggggcatggaggcaagtcgaaaaagtcgaaacctgggcgttgagacacccagggttcaccattcttgccctcttccttgcacactatataggtacatcactaactcagaaagttgtaatatttattctcctgatgctcgtaacgccctccatggcgatgcgatgtgtaggagtcggaaacagagacttcgtcgaaggcctttccggggcaacgtgggtagatgtagttctggaacatgggggatgcgtaactactatggccaaaaataaacctaccctagacatagaattacagaaaacagaagctacccaactggcaacgctcaggaaactatgcatagaagggaagatcaccaacatcacaaccgacagccgctgcccaacacaaggcgaagcaatactacccgaagaacaagaccagaactacgtctgcaaacatacttatgtcgaccgaggatgggggaatggatgtgggcttttcggaaaagggagtctagtaacttgcgcgaaatttcaatgcctggaatcgattgagggaaaagtcgtccagcatgaaaatttgaagtacacagtaaccataaccgtccacacaggcgaccagcaccaggtcggtaacgacacacagggagtgacagccgaaatcacgccacaagcgagcacagtagaggcgatcctacccgaatatgggaccctaggcctcgaatgtagcccgagaacaggactcgactttaacgaaatgatcctactgacaatgaaaaacaaagcatggatggtacatcggcaatggttcttcgacttgcctctcccgtggaccagtggtgcaatcacggagacaccgacctggaacaggaaagaacttctggtcacattcaaaaacgcccacgcgaagaaacaagaagtagtcgtactcggctctcaagagggagcgatgcacacagcactaacgggcgcgaccgaaatccagaactcaggagggacatccatcttcgccggccacctaaaatgcagactcaaaatggacaaactcgaactcaaggggatgtcctacgcaatgtgcctgaacacattcgtcctgaaaaaggaagtttcagaaacccagcacggaacaatcctaatcaaggtcgaatacaagggggaggatgccccttgcaagatccccttctcaaccgaggacgggcaaggcaaggcccacaatggccgactaataacagccaatccggtagtaaccaagaaagaagaaccggtaaacatcgaagcggaaccccctttcggtgagagcaacatcgtgatcggcataggggacaaggcactaaaaatcaactggtacaagaaaggaagttccatcgggaagatgttcgaagcaacggcgagaggggcacggcggatggcaatcctcggagacactgcgtgggacttcgggagcgtcggcggggtactgaactcactaggaaaaatggttcatcaaatcttcggatccgcatacacagcactattcgggggcgtgagctggattatgaaaataggtataggcgtactcctcacctggataggcctgaatagcaagaatacctccatgagtttttcatgcatcgttatcggcatcataacactgtatctaggcaccgtcgtacaagcagacatgggatgtgtcataaactggaaagggaaagagctaaaatgtggtagcggcatattcgttaccaacgaagtacacacatggacagagcagtataagttccaagccgacagccccaaaaggctcgccacagcgattgcaggggcctgggaaaacggggtatgtggcatacggtcgacaacgcggatggaaaacctcctttggaaacagatcgccaatgaactgaactatatattatgggaaaacaacatcaaactcacggtcgtcgtaggggacatcatcggcgtgctggagcaaggcaagcgaacgctgactccgcaaccaatggaattaaagtattcctggaaaacttggggtaaagcaaagatcgttacggccgaaatacaaaacagctcatttataatagacggccccaacacacccgagtgcccatcagcctcgcgagcgtggaacgtctgggaagtcgaagactatggatttggagtctttaccacaaacatatggctaaaacttcgagaggtctacacacaaacgtgcgaccatcgactcatgagcgcagctatcaaggacgaacgagccgtacacgccgatatgggctattggatcgagagccagaaaaacggatcgtggaaactcgaaaaggcctcttttattgaagtgaaaacctgcacatggccgaaatcccacacactatggagtaatggcgtactggagagcgacatgataattccaaaaagtctcgcaggcccaatctcacagcacaatcacaggccaggttaccacacccaaaccgccggaccatggcacctcgggaaactagagttggatttcaattattgcgaaggcacaaccgtagtcatcactgaaaactgcggtaccagaggcccgtcactgcggacaacgaccgtaagcggcaaacttatccacgagtggtgttgccgctcatgcacccttccacccctacgctacatgggtgaggacgggtgctggtatggaatggagataaggcctatcaacgaaaaagaagaaaacatggtaaagagcctagtcagtgcaggttcaggcaaagtagataactttaccatgggagtcctgtgcctggccatactcttcgaagaagtaatgcgaggcaaattcggtaagaagcatatgatcgcgggggtactccttacatttatgttactactatccggacagattacctggagagacatggcacacacacttatcatgatcggctccaacgcttctgatcgcatggggatgggcgtgacctacctggcgctcattgcaaccttcaagatccaaccgttcctagcgcttgggttctttctacgtaagctaacatcgcgcgagaacctcttactaggagtgggtctcgcgatggcaacaacgctccaactacccgaagacattgagcaaatggcaaacggaatagcgctgggtctcatggcgctcaaacttataacgcaattcgagacatatcagctctggaccgcacttgtcagtctgacctgcagcaacactatttttacgctaactgtggcctggcgcacggcaacactgatcctagcaggggtgtcgctgctacccgtatgccaatcaagcagcatgagaaaaactgactggcttccagtcgccgtagccgccatgggcgtcccaccactgcctctgtttatattctcactcaaagatacattaaagcggaggtcttggccactgaacgaaggcgtgatggcggtaggcctagtgtcaatcctagcttcatccctacttaggaacgacgttcccatggcaggtccattagtcgcgggaggattacttatagcttgttatgtgatcacgggaacgagcgcggatctgacagtagagaaagcagccgatgtgacgtgggaagaagaagccgagcagaccggagtgtcgcacaacctgatgattacagtggacgacgatggtactatgagaataaaagacgatgaaacagaaaatatcctaaccgtcttgctaaagacagcactcctaattgtatctggcattttcccgtatagtataccagctacactacttgtctggcacacgtggcaaaagcaaacgcaaagaagcggcgtgttatgggatgtaccaagcccaccagaaacccagaaggcagagctagaagaaggagtttacagaattaagcaacaaggcatcttcggtaagacgcaagtcggagttggcgtgcaaaaagagggggtgttccatacaatgtggcatgtaacccggggagcagtcctaacgcacaatggtaaaaggctcgagcctaactgggcctcggtcaagaaagacctaataagctacggaggaggctggaggctaagtgcccagtggcagaaaggtgaagaagtacaggtcatagccgtagaacccggcaggaacccgaaaaatttccagacaatgcccggcatattccagacaaccacaggggaaataggcgcgatcgccctggacttcaaaccagggacgtccggatcacccattatcaacagagagggcaaggtcgtcggactctacgggaatggcgtggtcaccaagaacgggggctacgtaagcgggatcgcgcaagcgaacgccgagccggacggccccacgcccgagctggaagaagagatgttcaagaaacgtaaccttacgataatggatctgcaccccggctcaggaaaaacaagaaaatatctgccagccatcgtacgcgaagcgattaaacgcaggctgcgaactttaatcctggcgccgacacgggtagtggccgctgaaatggaggaagcactaaaaggactaccgattcgttaccagacgacagccacgaaaagcgaacacactggcagggaaattgttgacctcatgtgccacgcgacgttcaccatgcgcctgttgagcccagtaagagtccctaattacaacctcatcataatggacgaagctcacttcacagaccccgcatctatagctgcgaggggttacatttccacacgggtaggcatgggagaggccgcggcaatcttcatgacagccacaccacccggcacagcggaagcattccctcaatcgaatgccccgatccaagacgaggagcgagacatcccagagagaagttggaactcaggaaacgaatggatcactgatttcgtcggcaaaacagtctggttcgtaccctccataaaagctggcaacgatattgccaactgcctgaggaaaaacggcaagaaggttattcaactaagccgaaagacctttgacactgaataccagaagacaaaactaaacgactgggatttcgttgtcacaacggacatctccgaaatgggagcaaatttcaaggcggaccgagtcatcgaccccagaaggtgcctcaaacccgtcatactgacagatggtcccgaaagagttatccttgctggacccatgcccgtcacagcagcatcggcagcccaacgcagagggagagtgggtcgcaacccacaaaaagaaaatgaccaatacatcttcaccgggcaacccctaaacaacgacgaagaccacgcacactggacagaggcaaaaatgttgttggacaacataaacacgccggaaggcatcatcccagctctctttgagccggaacgtgagaaaagcgctgccatcgatggcgagtaccgcctcaagggtgagagcagaaaaaccttcgtagagctaatgagacgcggcgatctgccagtctggctcgcccacaaggttgccagcgaaggcataaaatacaccgaccggaagtggtgcttcgacggcgagcgcaacaaccaaattctagaggaaaatatggatgttgaaatatggaccaaggaaggagagcgcaagaagctacgtcccaggtggttggacgccaggacatactcggaccccctcgcgctcaaagaatttaaggacttcgccgcaggcaggaaaagcattgccctcgacctagtaaccgaaataggacgagtacctagccacctggcccatagaacacggaacgccctcgacaacttagtcatgctgcacacatcagagcacggagggcgagcgtaccgccatgcagtagaggaactccccgaaaccatggagaccctattgctgctagggctgatgatactcctaaccggcggggctatgctattcctaatatcgggaaaaggaataggaaaaacctcaatagggctaatctgcgttatagtatcatccgggatgctatggatggcagatgtccccctacagtggatcgcttccgcaattgtcctggagttcttcatgatggtacttctgattcccgagcccgagaagcaaaggaccccacaggataaccaactcgcatacgtcgtcattgggattctgacgctggcagcgatagtcgcagcaaacgagatgggcctcttggaaaccaccaagagagacctgggaatgagcaaagagcctggggtagtaagcccaacatcttacctcgacgtagacctccatcctgcaagcgcatggacactctacgcggtggcgaccacggtgatcacgcccatgctacgacacacaatcgaaaactcaacagcgaacgtatcactcgccgccattgcaaatcaggccgtggtgctcatgggactcgataagggatggcccattagcaaaatggacttaggagtacccctactggcgctaggatgctattcacaagtgaacccgctgacattaacggctgcagtgcttctactggtcacacactatgcaataataggtccagggttgcaggcaaaagccacccgagaagcccagaagaggacagcagccggaattatgaagaatccaacggttgatgggatcatgacgatagacctggacccagtgatatacgactctaaattcgagaaacagctcggacaggtaatgctactcgtcctgtgcgccgtccagttgcttctcatgcgaacaagctgggcactctgtgaagcactaacactcgccacaggacctatcacgaccttgtgggagggttcacccggaaaattctggaacacaaccatcgcagtaagtatggctaatatattccggggcagctacctcgcaggcgccgggctagcattctcaattatgaaaagcgtggggaccggcaaaaggggcacaggctcgcaaggggaaacccttggcgaaaaatggaaaaagaaacttaaccaactatcaaggagggagtttgaactatataagaaatcaggaatcaccgaagtcgatcgtaccgaggcaaaagaaggcctaaaaagaggtgaaacaacacaccacgccgtaagccgaggttccgccaaactccaatggttcgtagagagaaacatggtaatcccagagggcagggtaatcgacctcggatgcggaagagggggatggtcttactattgcgccgggttgaagaaggtaaccgaggtgcgcgggtacaccaaaggagggcccggtcacgaggagcccgtaccaatgagtacatacggctggaacactgtcaaattaatgtccggcaaagacgttttctacttgccaccggaaaaatgcgacaccctcctttgtgacataggagaatcctcgccctcacccacagtggaggaaagcaggactatcagagtcctgaagatggtcgagccgtggctcaaaaacaatcagttttgcataaaggtactgaacccttacatgccaacagttatcgagcacctcgaacgccttcaacgaaaacacggtggtatgcttgtgcgcaatcccctgagtagaaactcgacacacgaaatgtattggataagcaacggaaccggaaacatagtatccagcgtaaacatggtctctcgtcttcttctcaaccggttcaccatgacgcaccgaaggccaaccatagaaaaagacgtcgacctaggtgccggaacacgacacgtaaacgcggaacccgagacgcccaacatggatgtcataggcgagcgaattaaacgaatcaaagaggaacacagttccacatggcactacgacgacgaaaacccatataaaacatgggcgtatcacggctcgtatgaagtcaaggcaacagggtcggccagcagcatgataaacggtgtagtaaaactcctcaccaagccgtgggacgtagtaccgatggtcacacagatggcaatgacggacaccacgccatttggccaacaacgtgtattcaaagaaaaggtagatacacgcacaccacgaccaatgccaggcaccagaaaggtcatggagatcacagccgaatggttatggcggaccttagggaggaacaaacgacctcgattatgtaccagggaagagttcacgaagaaagtaagaacgaacgcagctatgggagctgtatttaccgaggagaaccagtgggagagcgcaagagcggcagtggaggatgaagagttctggaaactggtaggccgagaaagagagctacacaagctggggaagtgcggctcatgtgtatacaacatgatgggcaaaagggagaagaaattgggcgaatttgggaaagcgaaaggatcaagagccatatggtacatgtggctaggcgccaggtacctagagttcgaggcgctaggattcctaaacgaagaccactggtttagtcgagaaaactcctatagtggtgtggaaggggaaggactgcacaaattaggctatatactacgcgacatcagtaaaataccaggcggggcaatgtacgcagacgacacagcaggctgggacacaagaataactgaggacgacttgcataacgaagagaagatcacacaacagatggatccggagcacagacaactagccaacgccatattcaaactaacctaccagaacaaagtcgtaaaagtccaaagaccaacgccgaagggaacagtcatggacatcatttcgaggaaagatcagcgaggatctgggcaggtaggaacttacggactgaacacgttcaccaacatggaggcccagctaattcgacaaatggagggggagggtgtactgtctaaagcagatctagaaaatccacacctattggaaaagaaaattacccaatggctggagaccaaaggagttgagcgactaaaaagaatggctatctcgggagatgattgcgtagttaaaccaatagacgatcggtttgccaacgcattgttagcattaaacgacatggggaaggtaaggaaagatataccacaatggcaacctagtaaggggtggcacgactggcaacaagtacctttctgctcacaccactttcacgaactcataatgaaggacgggcgaaagctagtggtaccatgccggccgcaagacgaactcataggaagggctcggataagccagggagcgggatggtcactcaaggaaacggcatgcctaggaaaggcctacgcacaaatgtggagtctcatgtacttccaccgacgcgacctacgcttagcatcaaacgccatttgctcagctgtccccgtacattgggtcccaacaagtcggacgacgtggagcatccacgcgcaccaccagtggatgacgaccgaagatatgctaacagtatggaatcgagtctggatagaagacaatccttggatggaagacaagacccccgtcaccacatgggaggacgtcccatacctcggcaaaagggaggaccaatggtgtggctcactaatcgggcttacaagccgggccacctgggcacagaacatactaaccgcgatccaacaagtaagatccctcatcggcgacgaagagttcctagattatatgcccagcatgaagcgcttcaggaaggaggaagagtccgaaggagctatatggtag

SEQ ID NO: 26146 - RNA, 9873 nt, synthetic construct
  misc_feature 1..9873: note = derived and/or modified CDS sequence (opt11) from DENV-3__KJ622193__SS-prME
  source 1..9873: mol_type = other RNA
accagcctgtgtctgatgatgatgctgccagcgaccctggcgttccatctgactagtcgggacggcgagccccggatgatagtgggcaagaacgagcggggcaagagcttgctgttcaagactgcgtctggcattaatatgtgcaccttaatcgccatggacctgggcgagatgtgtgacgacacggttacttacaagtgccccctgatcgccgaggtggaacccgaagacatcgactgctggtgcaacctcaccagcacatgggtgacatacgggacgtgcaaccaggccggcgagcaccggcgcgataagcggtcagtggccctggcgccgcacgtgggcatgggattggacacgcgcactcagacctggatgagcgccgagggcgcctggaggcaggtcgaaaaggtggagacgtgggctcttaggcacccagggtttaccatcctcgcactttttctcgcccactacataggcacttccctgacgcagaaagtggtgatcttcatcctcttgatgctggttacgcccagcatggccatgcggtgtgtgggggtgggcaaccgcgactttgtcgagggcctgtccggggctacctgggtggacgtggtactcgagcatggggggtgcgtgaccaccatggccaagaacaagcccacgcttgacattgagctgcagaagaccgaagccacccagctcgccaccctgcggaagctgtgcatcgaaggcaagatcacgaacattacgactgacagccgctgccccacccagggcgaggccattctccccgaagagcaagaccagaactacgtgtgcaagcatacgtacgtcgataggggttggggcaacgggtgcggcctgttcggaaagggcagcctggtgacctgcgccaagttccaatgtctggagagcatagagggcaaagtggtgcagcacgagaacctgaagtacaccgtgacaatcaccgtgcacaccggtgaccagcaccaggttggcaatgacacccaaggggttaccgccgaaatcacaccccaggcgtcgaccgtcgaggccatcctgcccgaatacggcacactcggtttggagtgcagccctcgcaccgggctggactttaacgagatgatcctcctgaccatgaagaacaaggcatggatggtgcatcggcagtggttcttcgacttaccgctgccctggacgtcgggcgccattaccgagacgcccacctggaacaggaaggagctgctggtgaccttcaaaaacgctcacgcgaagaaacagggggtggtggtgctcggcagccaggagggggccatgcataccgccttgaccggggccaccgagattcagaattccggtggaacgtctatttttgccggccacctgaagtgccggctcaagatggacaagctggaactgaaagggatgtcctacgctatgtgcctcaacacgttcgtcctgaagaaggaggtgagcgagactcagcacggaacaatcttgatcaaagtggagtacaagggggaggacgccccctgtaaaatccccttcagcactgaggacgggcagggcaaggcacataacgggcgcctgatcaccgctaaccccgttgtgactaagaaggaagagcccgtgaacatcgaggcggagccgccattcggcgagagcaacatcgtgattgggattggggataaagccctcaagatcaactggtataagaaggggagctcgataggcaagatgttcgaggccaccgctcggggtgcccgacggatggcgatactgggggacaccgcctgggacttcggcagcgtaggcggggtgctgaactcccttgggaagatggtccaccagatattcggatccgcgtacaccgccctgtttggcggggtctcatggatcatgaagatcgggatcggggtgctgctcacctggatcggactgaacagcaagaacacctccatgagcttctcgtgcatagtcatagggatcataactctgtacctcggcaccgtcgtccaggcggacatgggctgtgtaatcaactggaaggggaaggagctaaagtgcggtagcgggatcttcgtgacaaacgaggtacacacgtggacggagcagtacaagttccaggccgactcgcctaagcgcctggccacagcaatcgccggcgcttgggaaaacggggtttgcggcatccgcagcaccacccggatggagaacttgctatggaagcagatcgcgaacgagctgaactacatattatgggagaacaacatcaaattgacagtggtagtcggcgacataattggggtcctggagcaaggcaagcgaaccctcacgccccaacccatggagttgaagtattcctggaagacctggggcaaagccaagatcgtgaccgctgagattcagaacagcagttttatcatcgacgggccgaacacccctgaatgcccctctgccagccgggcgtggaatgtctgggaggtagaagactacggcttcggcgtgttcacaaccaacatctggctgaagctacgcgaggtctatacgcagacctgcgaccaccgcctcatgtcggctgccatcaaggacgagcgcgccgtccacgccgacatgggatactggatcgagagccagaaaaatgggagctggaaactggagaaggcgagcttcatcgaggtaaagacgtgcacgtggcccaagtcccacaccctctggagcaatggggtcttagagtccgacatgattatccccaagagcctggccggacccatctctcagcataaccacagacccgggtaccacacgcaaaccgccggaccgtggcatctggggaagttggaacttgactttaactactgtgaaggcaccaccgtggtaatcacggagaactgtgggacccgcggccccagcctccggaccaccaccgtatccgggaagctgatccacgagtggtgctgccgttcttgtaccttgcctcccctgcggtacatgggagaggacggatgctggtacgggatggagatccgcccgattaacgaaaaggaggagaacatggtaaagtccttggtgagcgccggctcagggaaggttgacaacttcaccatgggcgtcctttgcctcgccatcttattcgaggaggtcatgcggggcaagttcggcaagaagcacatgatcgcgggcgtcctgctcaccttcatgttgcttctctcggggcagatcacgtggcgtgatatggcccacaccctgataatgatcggttccaatgccagcgaccggatggggatgggcgtgacatacctggccctcatcgccacgttcaaaatccagccgttcctggcgctgggcttcttcctccgcaagctgacgtcccgggagaacctgctcctgggggttggcctggctatggccaccaccctccaactgcccgaggacatagagcaaatggcaaatggaatagcgctgggcctgatggctttgaagctgattacacagttcgagacttaccagctctggaccgctctggtcagcctgacgtgctctaacaccatcttcacgttgaccgtggcctggcgaaccgccaccctgatcctggcgggggtgtccctcctgcccgtctgccagtcgtccagcatgcggaaaacggattggctgccggtggccgtcgctgcaatgggcgtgcctccattacccctgtttatcttttcattaaaggacaccctaaagcgccgctcgtggccgctgaacgagggggtgatggccgtcgggctagtgtcaatcctcgcaagctccctgcttcggaacgatgttcctatggcaggccccctcgtcgccggaggcctgctgatagcctgttacgtcatcaccggtaccagcgccgacctcacggtggagaaggcggcggacgtcacctgggaggaagaggcggagcagacaggcgtatcccacaacctgatgatcaccgtagacgacgacggcacgatgcgcatcaaggacgacgaaaccgagaacattcttacagtcctcctgaagaccgccctgctcatagtgagcggtatcttcccgtactccatcccggccacactcctagtctggcacacgtggcagaagcagacccaacgtagcggcgtactctgggacgtgccgagcccgcccgagacccagaaggcggagctggaggagggggtttatcgtatcaagcagcagggcatctttgggaaaacccaagtcggcgtgggcgtgcagaaagaaggggtcttccatacgatgtggcatgtgacccgcggcgccgtgctgacccacaacggtaagcgcctagagccgaactgggccagcgtcaagaaagacctgatatcctacggcggcggttggcggttaagcgctcagtggcagaagggagaagaggtccaggtgattgcggtcgagcccgggcgcaaccccaagaacttccagaccatgcctggcatcttccagacgaccaccggggagatcggcgccatcgccctggactttaaaccgggcaccagcgggagcccgataatcaaccgcgagggtaaggtggtcgggctctacggcaatggggtcgtgacgaagaacggcggctacgtatcggggatcgcgcaggctaacgcggagccggacggccctacacccgagctggaggaggagatgttcaagaagcgcaacttaaccatcatggacctccaccccgggtccggcaagacccgtaagtacctgcccgccatcgtgcgcgaagccatcaagcggcgcctgcggactctgatactggctccgacccgcgtggtggccgcggagatggaagaggcactaaaggggctccccatcaggtaccagacgaccgccaccaagagtgagcacaccggcagagagatcgtcgacctgatgtgccacgccaccttcaccatgcgattgctctcccccgttcgcgtgcccaattacaacctgatcatcatggacgaagcacacttcacggacccggcgagcatcgccgcacgtggctacataagcacacgcgtcgggatgggcgaagccgcggctatcttcatgaccgcgacgccgcccggaacggccgaggccttcccccagagcaacgcacccatacaggacgaggagcgcgacatccctgagcggtcttggaacagcggcaacgagtggattaccgacttcgttgggaagaccgtgtggtttgtgcccagtatcaaggccggtaatgacatcgccaactgcctgcgcaagaacggtaaaaaggttatccagctcagccgtaaaacctttgacacagagtaccaaaagaccaagctgaacgactgggacttcgtcgtcaccaccgatatctccgagatgggggccaacttcaaggccgaccgcgtgatagatccccggcgctgcctgaaaccggttatcctcacggatgggcccgaacgggtcatcctggcggggcccatgcccgtgaccgccgccagcgccgcgcaacgccggggccgagtgggtcggaatccgcagaaggagaacgaccaatacatcttcactggccagcctctaaacaacgacgaagaccacgcccactggacagaggcaaaaatgctgttagataacatcaatacgcccgaaggcattattcccgccttgtttgagccagagcgcgaaaaatccgccgctatcgacggggagtatcggctcaagggcgaatctcgcaagacctttgtcgaactgatgcggcgcggggacctgccagtgtggctcgcccacaaggtagcctccgagggcatcaagtacaccgaccggaagtggtgcttcgacggagaacgcaataaccaaatcctggaggagaacatggacgtcgaaatctggaccaaggagggtgagcggaaaaagctgcgcccccgctggctcgacgctcggacctactctgacccgctggccttaaaggagttcaaggactttgccgccggcagaaagtccatagccctggatctggtgacggagatcgggcgggtcccgagtcacctggcccatcggacacggaacgccttagataacctcgtgatgctgcacacctccgagcatggtgggcgcgcgtaccggcacgccgtggaggaacttcccgagaccatggagacgttgctgctcttgggactgatgatcctcctcaccggtggtgcaatgctgttcctaatcagcggcaagggaatcggcaagaccagcatcgggctgatttgcgtaatcgtctcctcaggcatgctgtggatggccgacgtgcccctgcagtggatcgcgtccgcgatagtcctcgagttcttcatgatggtactactcatcccggagccggagaagcagcgcacgccacaggacaaccagctagcctatgtggtcatcggcatcctgacgctcgcggcgatagtggccgccaacgagatggggctgttagagactactaagcgggacctcggcatgtctaaggagcctggggtcgtctcccccacgagctacctggacgtggacctgcatcccgcctccgcgtggacgctctacgctgtagcgaccaccgttatcacgcctatgctgcgtcatacgatcgagaactctaccgccaacgtgtccctggccgctatcgcaaatcaggcggttgtcctcatgggcctggacaaaggttggcccattagcaaaatggatctgggagtgccactcctggccctgggctgctactcccaggtcaaccccctcaccctgaccgcggccgtccttcttctggtgacacattatgccataatcgggcccgggctccaagcgaaggccacccgggaggcccaaaagcgcaccgcagccgggatcatgaagaacccaaccgtcgacggcatcatgacgatcgacctcgacccggtcatctacgacagcaagtttgaaaagcagctgggccaggtgatgctgctcgtgctctgtgcggtccagttattgctgatgcggacgtcctgggccctgtgcgaggcgctcaccctggccaccgggcccattacgaccctgtgggagggcagccctgggaagttctggaacaccaccattgcagtctccatggccaatattttcagaggcagctacctggccggcgccggcttggccttttccatcatgaagtctgtgggaacggggaagcgtggcaccgggtcccagggcgagacgttgggggaaaagtggaagaagaagctcaaccagctctcaagaagagaattcgagctgtacaagaagtcaggcattaccgaagtcgaccgcacggaggcgaaggagggcctcaagcgcggggagacaacccaccacgccgtgtcccgcggcagcgcgaagctgcaatggttcgtcgagcggaacatggtgattcccgagggtcgcgtgatagaccttggctgcggtcgcggcggctggtcctactactgcgccggactcaagaaggtgaccgaggtccggggctacaccaagggcggcccggggcacgaagagccagtgcccatgagcacgtacggctggaacaccgtgaagctgatgtcaggtaaggacgtcttctatctgcccccggaaaagtgtgacaccctgctatgcgatatcggggagagctcacctagccccacggtggaggagtctagaacgatacgggtgctgaaaatggtcgagccctggctgaaaaataaccaattctgcatcaaggtgttgaatccttacatgcccaccgtgattgagcacctggagcgcttgcaacgtaagcacggcgggatgttggtccgcaaccccctaagccggaactccacccacgagatgtactggatcagcaatggcacgggcaacattgtatcttctgtgaatatggtaagtcgccttctcctcaaccgctttacgatgacccatcgcaggcccacaattgagaaggatgtggaccttggggccggcacccgccacgtcaacgcggagccggagacgcccaacatggacgtgatcggggagcgaatcaaacgcatcaaggaggagcacagctccacttggcactacgatgacgagaacccatacaagacctgggcctaccacggcagctacgaggttaaggcaaccgggtctgcaagcagcatgataaacggggtcgtgaaactcctgacgaagccgtgggacgtggtccctatggtgacgcagatggccatgaccgacaccacgcccttcggccagcaacgggtattcaaagaaaaagtcgacacccgcacgccccggccaatgcccggtacccgcaaggtaatggagatcaccgccgaatggttatggcggacactagggcgcaacaagcgcccccggctatgcacccgcgaagaattcaccaagaaggtgcgtacgaacgccgccatgggggccgtcttcacggaggagaatcagtgggagtccgcgcgcgcagctgtagaggacgaggaattttggaaactggtgggccgagagcgcgagctccacaagttagggaagtgcggcagctgcgtctacaatatgatgggcaagcgggaaaagaaactaggcgagttcggcaaggccaaggggtcgcgtgccatctggtacatgtggttaggcgcgcggtacctggagttcgaggccctggggttcctcaatgaagaccactggttctcacgcgagaactcctacagcggcgtggaaggtgaggggctgcacaagctggggtacatcctccgggatatatccaagatccccgggggtgccatgtacgccgacgacaccgccggatgggacacccgcatcacagaggacgacctgcacaatgaggagaagatcacccagcagatggacccggagcaccggcagttggcgaacgccatcttcaagctcacctaccaaaacaaggttgttaaagttcagcggcccaccccaaaggggaccgttatggacatcatcagccgcaaagaccagcgcggctccgggcaagtcggcacctacgggttgaatacctttaccaacatggaggcccagctgatccgtcaaatggagggagaaggcgtgctcagcaaggccgacctggagaacccccatcttctcgagaagaaaatcacccagtggctagaaactaaaggggttgagcgattaaaacggatggccatctccggtgacgactgcgtcgtgaagccgatcgacgaccgtttcgcgaacgccctgctagccctgaatgatatggggaaagtgcgaaaggatataccccaatggcagcccagcaagggctggcacgattggcagcaggtgcccttctgctcacatcactttcacgagctgatcatgaaagacgggcgcaaactagtggtgccctgccgcccccaggacgaactgatcggacgggcacgaatctcccagggcgccgggtggtccctcaaggagactgcatgtctgggcaaagcctacgcccagatgtggagcctgatgtacttccatcgtcgcgacctccggctggcctccaatgcgatctgcagcgcagtccccgtgcactgggtgccgacctcccgcaccacgtggagcatccatgcccaccaccagtggatgacgaccgaggacatgctgaccgtctggaacagagtgtggatcgaagacaacccctggatggaggacaaaacgcccgtgaccacctgggaggacgtaccgtacctcgggaagcgcgaggaccagtggtgcgggagcctgatagggctgacctcccgggccacatgggcccagaacatactcacagcgatccagcaggtccgcagcctgattggcgacgaagagtttcttgactacatgccctccatgaagcgtttccgtaaggaggaggagagcgagggtgccatctggtga

SEQ ID NO: 26147 - RNA, 9873 nt, synthetic construct
  misc_feature 1..9873: note = derived and/or modified CDS sequence (opt11) from DENV-3__KJ622194__SS-prME
  source 1..9873: mol_type = other RNA
acttcactatgcttgatgatgatgctacccgctacccttgcatttcatctgacaagccgagacggcgaacccagaatgattgttggcaaaaacgaaagagggaaaagtctgctgtttaaaacagccagtgggataaatatgtgcacactaattgcaatggatcttggcgaaatgtgcgatgacacggtaacatataaatgtccattgatagcagaagtagaaccggaggacatcgactgctggtgtaatctgacgagcacctgggtgacgtatggcacatgcaatcaagctggcgagcaccgacgagacaaacggtccgttgccctagcaccgcacgtcggcatgggcctcgacaccaggacgcaaacctggatgtcggcagagggagcgtggagacaggttgaaaaagtcgagacatgggccctccggcacccagggtttacaattctcgcattgtttctagcacactacatcgggacaagcctcacgcagaaagtagtgatcttcatactgttgatgctagtcacgccctcaatggctatgcgctgcgttggagtaggcaaccgcgacttcgtcgaaggtctttctggcgcaacctgggtagacgtcgttctggaacatggtggctgcgtgacgaccatggccaaaaataaaccgactctggacatcgaactccagaaaactgaggcgacccagttagcaaccctaaggaaactatgcatcgagggaaaaattactaatatcacaaccgactcacggtgccccacgcaaggcgaggcaatattacccgaagaacaggatcaaaattacgtgtgcaaacatacctatgtggaccgcggctggggcaacggttgtgggctgttcggtaaaggaagcctggtaacctgcgcgaaattccaatgcctcgagagcatcgaagggaaagtggtacagcacgaaaacctcaagtatacagtgaccatcacggtccacaccggtgaccagcaccaagtagggaacgacacccagggcgtaaccgccgagatcacgccgcaagcaagtacagtagaggcgatcctaccggagtatggaactctcggcctagaatgctcaccgagaacaggactcgatttcaacgagatgattctcctaaccatgaagaacaaggcctggatggtccaccgccagtggttcttcgatcttccactcccttggacttcaggcgcaatcactgagacacctacctggaatcggaaagaactgctagtgactttcaaaaacgcccacgccaagaagcaggaagtagttgtcctcggttcccaagagggagcgatgcacaccgcgctcaccggcgcgaccgagattcaaaatagcggtggtacctcgattttcgctgggcacctgaagtgccgactaaaaatggacaaattggagctgaagggcatgagctacgccatgtgtctcaatacattcgtgctaaagaaagaagtgtctgaaacacaacacggcacaatcctcataaaagtcgagtacaagggcgaagacgcaccctgtaagattcctttcagtaccgaggacggacagggaaaagcccacaacggaagactgataactgccaaccccgtcgtgacaaagaaggaggagcccgtaaacatagaagcagaaccacctttcggcgagagcaacatagtaataggtatcggggacaaagcgttaaagattaactggtacaagaaaggcagtagcatcggcaagatgttcgaagccacggcgcggggcgcacggagaatggccatcttaggagacaccgcgtgggattttggatccgtcggtggcgtattaaacagcctagggaaaatggtacatcagatattcgggtcggcgtatactgctttgttcggcggtgtaagctggataatgaaaatcggtataggcgtcctactaacgtggatagggttaaactcgaaaaacacatccatgtctttcagctgcatagtcatagggatcatcacattatacctcgggacagttgtccaggcggatatgggctgcgtcataaactggaaaggtaaagaactcaaatgcgggagcggtattttcgtaaccaacgaagtgcatacgtggaccgagcagtacaaattccaggcggatagcccaaaaaggctagcaacagccatcgccggagcatgggagaatggcgtgtgcgggatacggagcactacccgaatggaaaatctactgtggaagcagattgctaacgaactcaactacatcctgtgggagaacaacatcaaactcacagtcgtcgtaggcgacatcatcggggtcctcgagcagggtaaaagaacactcacaccacaaccaatggaattgaagtattcctggaagacatggggaaaagcaaaaatcgtgaccgctgagatccaaaactcctccttcatcatcgacggaccaaatacacccgagtgcccgtcagcatcgagggcctggaacgtgtgggaagtagaggattacggattcggagtgtttacaaccaacatatggctcaagctcagagaagtatacacgcaaacctgcgaccacagactcatgtcggcggcgatcaaagacgagagagcagtacacgcagacatgggctactggatcgaatcacagaagaacgggagctggaaactggaaaaagcctcctttatcgaagtgaaaacgtgcacgtggccaaaatcacacacgctgtggagcaacggcgtcctcgagtccgacatgatcatcccaaaatccctggcggggcccatatcgcaacataatcatcgccctggctaccacacacagacagctgggccttggcacttaggcaagctcgagctagactttaattactgtgaaggaacaacagtcgtcatcaccgaaaattgtgggacgaggggaccctcactacgaaccaccacggtcagcggcaagctgatacacgaatggtgctgcaggagttgcactttacccccgctacgttatatgggcgaagacggttgttggtacggaatggaaataagaccaattaacgagaaggaggagaacatggtgaagtccttagtatcagctgggagcggaaaggtggacaactttacgatgggcgtgctctgtctggctatactgtttgaagaagtgatgcgaggcaaattcggaaagaaacacatgatagccggtgtcctgcttacattcatgctgctcctcagcggacagataacttggagggacatggcccacacactcatcatgatcgggtccaacgcctctgacagaatgggaatgggcgtaacgtacctagccctcatagcgacgttcaagatacaacctttcctcgcactcggcttcttcctccgaaaacttaccagcagagagaacctactcctcggagtaggactggcaatggccacaacactgcagcttcccgaggacatcgaacagatggctaacggaatcgcactaggcctgatggccctgaagctaatcacacaattcgaaacatatcaactgtggacagccctagtatccctgacatgctcaaataccatctttaccctcacggttgcgtggagaacagcgacactaatattggccggcgtctcactactcccggtatgccagagttcttcgatgcgaaagacggactggctccccgtagccgttgccgccatgggagtaccacctctcccactgttcatcttctcactcaaagacacacttaaacggcggtcttggcccttgaacgagggagtcatggcggtagggctagtgagcatcctggcctcatcccttctccgcaacgacgtaccaatggccggcccgctagtagcaggaggactcctgatagcgtgctacgtaataaccggtacctccgcagacctaacagtggaaaaagccgcagatgtcacatgggaggaggaggccgaacagacaggcgtctcccacaatctcatgattaccgtggacgacgacgggacgatgcgaattaaggacgacgagacagagaatatactaaccgtactattgaaaacagctctgcttatcgtatccggaatcttcccgtacagcataccggcaaccctcctcgtatggcacacatggcaaaagcaaacacaaagaagcggggtactctgggatgtaccctcacctccagagacccaaaaagccgagctcgaggaaggtgtatacaggatcaaacaacagggaatttttggcaaaacacaggttggggtgggggtccaaaaagaaggcgtctttcacactatgtggcacgtcacccgcggggcggtcctgacgcacagcggcaagcgtcttgagcccaactgggcatcagttaaaaaggatctaatatcatacggcggagggtggcgcctatccgcacagtggcaaaagggcgaggaggtacaggtgatagcagtagagccaggccgcaatccgaaaaacttccagacgatgccaggcatctttcagacgaccacaggcgaaataggagccatcgcactcgatttcaaaccggggaccagcggctcacctattataaatcgggaagggaaggtcgtcggcctctatgggaatggcgttgtaaccaagaacggtgggtacgtgagcgggatagcccaagcaaacgccgaacctgacggacctacaccagagctagaagaagaaatgtttaagaaacgaaaccttacgattatggacttacacccaggcagcggcaaaacccggaagtacctgccggccatcgtcagagaagcaattaaacggcgcctcaggaccctcatactagcccccacaagagtagtggcggctgaaatggaagaagcgctgaagggcctgcccattaggtatcaaaccacggccacaaagtcagaacacaccggtagggagatagttgaccttatgtgccacgcaaccttcaccatgagactacttagtccagtccgagtgcccaactacaacctgatcataatggatgaagcacatttcaccgaccccgcatcgatagcagcaagagggtacatcagcacccgagttggaatgggggaagccgcggccatatttatgacagccaccccacccggcacggccgaggccttcccgcaatccaacgcacccattcaagacgaagaaagagacatccctgaacgtagttggaactccggaaacgaatggatcactgactttgtcggaaaaaccgtgtggtttgtgcccagcattaaagcgggaaacgatattgccaactgcctaaggaaaaatggaaagaaggtgattcagttaagccgaaaaacctttgatactgagtaccagaaaaccaaattgaacgattgggactttgtagtcaccacggacatttcggagatgggagcaaactttaaagcggatagagtgatcgacccaagacgttgcctaaaaccggttatcctcaccgacgggccagagagagtaatcctcgcaggacccatgccagtaacagcggcctccgcggctcaaaggagggggagagtgggccggaatccccagaaggaaaacgaccaatacatattcacaggccaaccactgaacaacgacgaagaccacgcacactggacagaagcaaagatgcttcttgataacatcaatacaccggaagggattataccggccctcttcgaacccgagcgggaaaaatccgccgccatcgacggggaataccggctgaagggcgaaagccggaagacatttgttgagctaatgagacgaggcgacctgcctgtctggttagctcataaggtggccagcgagggcatcaagtataccgaccgaaagtggtgctttgatggcgagagaaacaaccagatactagaggagaacatggacgtagaaatatggacaaaagagggggaacgtaagaaactcagaccgcggtggctggacgcacgaacatactccgacccactagcactaaaggagttcaaggacttcgcagccggaaggaagtcgatcgctttggaccttgtcacagagatcgggagagttccgagtcacctcgcgcataggacgcgcaatgccctggacaatctagtaatgttacacaccagcgagcacggtggcagggcataccgacacgcagtggaagaactcccagagacaatggagacactgctactcctcggcttaatgatacttctaacaggcggtgcaatgttgttcctcatatcaggcaagggaatcgggaagacctccatagggctaatctgcgtaatagtcagctcgggaatgctttggatggcagacgtcccgttacaatggatagctagtgctatagtcctcgaatttttcatgatggtactattaattccagaacccgaaaaacagaggaccccacaggacaaccagctagcgtacgttgtcataggcattctgacgctagcagctatagttgccgcgaacgaaatgggactgttggaaacaactaaacgggatcttggcatgagcaaggaaccaggggtggtatcaccgacatcatacttggacgtggacttgcacccggccagcgcctggacattatacgcagtggccaccacagtgatcactccaatgctccgacacaccatagaaaattcaacggcaaacgtatcgcttgcggcgatcgctaatcaggctgttgtgctaatgggactagataaggggtggcccatatcgaaaatggacttaggcgttccccttcttgcactgggatgctactcccaagtgaatcccttgacgctaaccgccgccgtactcctgctagttacacattacgcaataataggacccgggcttcaagcgaaagcaactcgggaggcacaaaaacgaactgcagccggaatcatgaagaacccaacggtagatggaatcatgaccatagaccttgaccctgttatctacgactcgaagttcgagaaacagctgggccaagttatgctgcttgtactttgtgcggtacaactactgctcatgcgcacatcatgggcactgtgcgaggcactaacacttgcgacaggcccaattaccacgctgtgggaggggagcccggggaagttctggaacgcaacgatcgccgtaagcatggccaatattttcaggggaagttacctggcaggagccgggctcgctttcagcataatgaaaagcgtaggcaccgggaaacgtggcaccggcagccagggagaaacactcggcgagaaatggaagaagaaattaaatcaactgtcccgcagggaatttgaattgtataaaaagtccggaatcactgaagtcgacaggacagaggcaaaggaaggactcaagagaggcgaaacaacccaccacgcggtaagccgtggaagtgccaagctccaatggtttgtcgaaagaaacatggttataccggaaggccgggtcattgacctagggtgcgggcgcggtggttggtcatactactgcgccggactgaagaaagtcacagaggtgaggggctataccaaaggaggacccggtcatgaagaacctgtaccaatgagcacgtatggatggaacaccgtgaagctcatgagcgggaaggatgtattttacctgccaccggagaaatgcgacaccttactatgcgacataggagaatcatcacctagtccaacggtggaagaatcacgaacgatcagagttctgaaaatggtggaaccctggttgaagaacaaccagttctgtataaaagtactaaatccctacatgccaacagtcatcgaacacctcgaacgcctgcagcgcaaacacggaggaatgttggtacgaaaccccctgagcagaaacagtacacatgaaatgtactggatttccaatgggaccggcaatatagtcagcagcgtcaacatggtctcaagactgctccttaacagatttacaatgacgcacagaaggcctacaatagagaaagacgtagatctgggggcaggtacccgacacgtaaacgccgagccggaaacgcccaacatggacgtcataggagagagaataaaaagaattaaagaagaacatagtagtacctggcactacgacgacgaaaatccgtataaaacatgggcgtaccatggctcatacgaggtaaaggcgacgggatcagcatcatcaatgatcaatggcgtggtaaaattactaacgaagccgtgggacgtcgtgcccatggtcactcaaatggccatgacagacacgacgccgttcggacaacaacgcgtcttcaaggagaaagtagacacgcgtacaccccgaccaatgccaggaaccagaaaagtgatggagataacagccgagtggttatggcgtacgttaggccgaaacaagcggccccgactctgtacacgagaagagttcacgaagaaagtgagaacaaacgccgcaatgggtgccgtgttcactgaggaaaaccaatgggagagcgctcgcgcagcggtcgaagacgaggaattttggaagctcgtcggacgtgaacgcgagctacataaattaggcaaatgcggaagctgcgtctataacatgatgggaaagagagaaaagaaactcggagagttcggaaaggcgaaaggctccagggcaatatggtacatgtggttaggcgccagatatctcgagttcgaagcgctgggattcctaaacgaggaccactggttcagcagggaaaactcctatagcggagtagagggagagggcctgcacaaactagggtacatattacgcgacattagcaaaatacctggaggggcgatgtatgccgacgatacggcgggatgggacacccgcataacagaggacgatctgcataatgaggaaaagataacgcagcagatggaccctgagcaccggcaattagccaacgctatcttcaaactaacgtaccaaaataaggtagtaaaagtgcagcgacccacgccaaaagggacagtaatggatatcatcagcaggaaggaccaacggggctcaggtcaagtcggaacttacggactcaataccttcacaaatatggaagcccaactcatccgacaaatggaaggcgagggcgtgctcagcaaggccgacctcgaaaatcctcacctactcgagaagaaaattacccaatggttggagaccaaaggggtcgaaagactgaaacggatggcgataagcggtgacgattgcgtcgtaaagcctatagacgaccgcttcgccaatgctctacttgcgctcaacgatatgggcaaggtgagaaaagacatcccacaatggcaaccatccaaaggctggcacgattggcaacaggtgccgttttgtagccaccacttccacgaactcattatgaaggatggcaggaagctcgtagtcccgtgccggcctcaggacgaactaatcgggcgagcccgaataagtcagggcgccggctggagcctcaaggaaacggcatgcctcggaaaggcttatgcgcagatgtggtcactaatgtactttcatcgacgagatttaaggctagccagtaacgcgatatgctcagccgtgcccgtacactgggtgcctacgtcgaggacaacctggagcatacacgcgcaccaccaatggatgacgaccgaagatatgcttactgtttggaacagggtctggatagaggataatccctggatggaggacaaaaccccggtaacaacctgggaggacgtaccttacctaggcaagcgcgaagaccaatggtgcggctcattaatcgggttgacctcaagggcgacgtgggcacaaaacatcctaacagcaatacaacaggttcggagcctcataggagacgaagagttcctagactacatgccctcgatgaaacggtttaggaaagaggaggaatcggagggcgctatttggtga

SEQ ID NO: 26148 - RNA, 9873 nt, synthetic construct
  misc_feature 1..9873: note = derived and/or modified CDS sequence (opt11) from DENV-3__KJ622195__SS-prME
  source 1..9873: mol_type = other RNA
accagcctttgcctgatgatgatgctgccagccaccctggccttccatctaacgtcccgggacggcgaaccccggatgatcgtcggtaagaatgagcgtggtaagtcactgctgttcaagaccgcgagcggtataaacatgtgtacccttatcgctatggatctgggcgagatgtgtgatgacactgtgacatacaagtgtcctctaatcgccgaggttgagcccgaagatatcgactgttggtgcaatctaaccagcacctgggtgacctacgggacatgtaaccaggccggggaacaccgcagagacaagcgctccgtggccttggctccgcacgtgggcatggggttagatacgaggactcaaacttggatgtctgccgaaggtgcctggcgccaggtcgaaaaggtcgaaacgtgggccctccgccatccagggttcaccatcctggctcttttcctcgcccattatattggcacctcgctgactcaaaaggtggtaattttcatcctcctaatgcttgttacacccagtatggccatgcggtgcgttggggtagggaatcgggactttgtcgagggcctgtcgggggcaacttgggtggacgtggttctcgagcacggcgggtgcgtaaccacgatggccaagaacaagcccacgctggacatcgagctgcaaaagacagaggcaacacagctagccaccctgcggaaactgtgtatcgagggcaaaatcacgaatattacgacggacagccggtgccccacccagggggaggccatactacccgaagaacaggaccagaactacgtatgcaaacatacgtacgtcgaccgtgggtggggtaatgggtgcggcctattcggtaagggcagtcttgtgacctgcgccaagttccagtgtttagagagcatcgagggtaaggttgtccagcacgagaacctgaaatacacagtgaccattactgtgcacactggggaccagcaccaggttggcaacgacactcagggggtgaccgccgagattacgccccaagcgtctaccgtggaggctatcctgccagagtatgggaccctcgggttagaatgcagtccgcggacaggccttgacttcaatgagatgattctcctgacaatgaagaacaaggcctggatggtacaccggcagtggttcttcgacctaccgctcccgtggacgtcgggtgccataaccgagacccctacctggaaccgcaaggagctgctagtcacgtttaaaaacgcccacgccaagaagcaggaagtcgtagtcctcgggtcacaggagggggccatgcataccgccctgaccggggccacggagatccaaaactccggcgggacctcaattttcgcaggtcacctgaaatgtcggcttaaaatggacaaactcgaactgaagggaatgtcctacgctatgtgtctcaacaccttcgtcttgaaaaaggaggtaagcgagactcagcatggcacaatcctgatcaaagtagagtacaaaggcgaggacgccccgtgcaaaatcccgttctcgacagaggacgggcagggcaaagcgcacaacggcaggctgatcaccgccaaccccgtcgtgacaaaaaaggaggagcccgtgaacatcgaggctgaacccccgttcggggagtcgaatatcgtcatcgggatcggcgataaagccctgaagataaactggtacaagaagggatcgtccattgggaaaatgttcgaggctacagccaggggcgcgcgccgtatggccatcctgggtgacacggcatgggactttggtagcgtaggaggggttctgaactccctcggcaagatggtacaccagatcttcggaagcgcgtacacggcactgttcggaggtgtatcctggatcatgaagatcgggattggagttctgctaacgtggatcggcctaaattccaagaacacctccatgagcttcagctgtatcgtgatcggcatcatcaccctgtacttagggaccgttgttcaagccgacatgggatgcgtgattaactggaaaggtaaggagctgaagtgcggtagcggcatatttgtgaccaacgaggttcacacctggacggagcagtacaagtttcaggcggactcccctaagagactggccaccgccatcgccggggcctgggagaacggcgtgtgcgggatccgctctaccacccggatggagaacctcctatggaagcaaatcgccaatgagttgaactatattctctgggagaacaatataaaactgacagtggtcgttggcgacatcatcggagtgctggagcaggggaagcgcaccctcaccccccagccaatggagctgaagtacagttggaagacctggggcaaggccaagatcgtgactgccgagattcagaacagctccttcatcatcgacgggccgaataccccagaatgccccagtgcatcacgggcctggaacgtctgggaggtcgaggactatggcttcggcgtcttcaccaccaacatatggctgaaacttcgcgaggtctacacgcaaacctgcgatcatcggctcatgtctgcagcgataaaggacgagcgtgctgtgcacgccgacatgggctactggatcgagagccaaaagaacgggtcctggaaactggagaaggcgagtttcatcgaggtgaagacctgcacgtggcctaagtcccacaccctttggtcgaacggcgtcctggagtccgatatgataatccccaagagcctggccggccctatctcacaacacaatcatcgtcctgggtaccacacgcagacagctggcccatggcacttgggcaagcttgagctggactttaactactgcgaaggaaccactgtggtcatcaccgaaaactgtggcacccgggggcccagcctccgaaccaccacggtatctggaaagctaatacacgagtggtgctgccgctcgtgcaccctaccgcccttgagatatatgggggaagatgggtgttggtacgggatggagatcagaccgatcaacgaaaaggaagagaacatggttaagagcctggtcagcgcgggaagtggaaaggtagacaatttcacaatgggtgtcctgtgcctcgcaatcttgttcgaggaagtgatgcggggcaagttcggcaagaagcacatgatcgcgggcgtcctgttgaccttcatgctgttattaagcgggcaaataacatggcgcgacatggcgcacacccttataatgatcggtagcaacgccagtgaccggatgggtatgggagtgacgtatctggccctcatcgccaccttcaagatacagcccttcctcgctttgggtttcttcctccgcaagctcacgtcccgagagaatctcctcctgggcgtaggtctggcaatggccaccaccctccagctccccgaggacatcgagcaaatggccaacggaatcgcgctcgggctgatggccctaaaactgatcacacaattcgagacttaccagctctggaccgccctcgtctccctgacatgttcaaacaccatattcaccctcaccgtagcctggcgcaccgccaccctgatcctggcaggcgtgtcgctcctgcccgtctgccagtccagcagcatgcgaaagacagactggctgccggtagcagtggccgcaatgggggtgccgccgctacccctgtttatcttttccctaaaggacacccttaagagacgcagctggcctctgaacgagggcgtgatggccgtcggtctggtatccattctcgcgagttccctgctgcggaatgacgtgcccatggccgggcccctagtggccggcgggttactaattgcttgctacgtcatcaccggtaccagcgcggacttgacggtggagaaggcggccgacgttacttgggaggaggaagcagagcagactggtgtctcgcacaatctgatgatcaccgtggacgatgacggcaccatgcgcatcaaggatgacgagaccgagaatatcttaactgtcctactgaagaccgccttgttaatcgtcagcgggatcttcccctattccatacctgccacgttgctagtgtggcacacgtggcaaaagcagacgcaacggagcggggtcctctgggacgtgcccagccctcccgaaacacagaaagctgagctggaagagggcgtgtaccgcatcaagcagcaggggatattcggcaagactcaggtcggcgtgggagtacagaaggagggcgtcttccatacgatgtggcacgtgacccgcggcgcggtcctcacccataacggcaaacgcctcgaaccaaattgggcatccgtcaagaaagacctgatcagttacggaggcggctggcggctgagcgcacagtggcagaagggcgaggaggtccaagtgatcgcggtcgagcccggccggaaccccaagaactttcagaccatgcccgggatcttccaaacgaccacaggcgaaatcggggctatcgccctggactttaagccggggacgagtggcagcccaattattgaccgggaggggaaggtggttggtctctacgggaacggtgttgtgactaagaacggggggtatgtaagcggcatcgctcaagccaatgcggagcccgacggtccgactcccgagctggaggaggagatgttcaagaaacgcaatttgaccatcatggatctacaccccggtagtggcaagacacgtaagtacctacccgccattgtacgagaggccatcaagcggcgattgaggacattaatcctggcccctactcgcgtagtcgcggcggaaatggaggaggcacttaagggcctccccatacgataccagactacagccaccaagtccgaacataccggccgcgagatcgttgacctcatgtgccacgccacttttaccatgagactgctcagcccggttcgggttccaaattataacctgattataatggacgaggctcacttcacggacccggccagcattgcagcaaggggctacatcagtacccgcgtcggcatgggggaggcggctgccatcttcatgacagccaccccgccaggaaccgcggaggcgtttccccaatctaacgcgccgatccaggacgaggaaagagatatccccgaacggtcatggaacagcggaaacgaatggatcaccgatttcgtgggcaagaccgtctggttcgtacccagcattaaggcgggcaacgatatcgccaattgtctcagaaagaacggtaagaaggtgatccagcttagtcggaagacattcgataccgagtaccaaaagacaaagcttaacgactgggacttcgtggtcacaaccgacatctccgaaatgggcgccaatttcaaggcggatcgggtgatcgacccccgacgctgtctgaagccagtgatcctcacggacggccccgaaagagtcatcttagcgggtcccatgcccgtgacagctgcgagcgccgcccagcgccgggggcgtgtaggcaggaacccgcagaaagagaatgatcaatacatctttaccggtcaacccctgaataacgacgaagaccatgctcattggacggaggccaagatgctactcgacaatatcaacactcccgaaggtatcatccccgcgttgttcgagccggaacgagagaagagcgctgcgatcgatggcgagtaccggctcaaaggggagagccgtaagactttcgtcgagctgatgcgtcgcggcgacctaccggtgtggctggcccacaaggtagcctccgaaggtatcaagtacaccgaccggaagtggtgcttcgacggcgagcgcaacaaccaaatactggaggagaacatggatgtggaaatctggactaaagagggcgaaaggaagaagctgcggcccaggtggctcgacgcccggacctactcaaatcccctggccttgaaggagtttaaggacttcgcggccggacgtaagtcgatcgcgctcgacctagtgacggagattggccgggtaccatcccatctggcgcacagaacccgcaacgccttagacaacctagtcatgctgcacacctccgaacacggggggcgcgcgtatcggcacgccgtggaggaactccctgagaccatggagacgctgctgctcctgggactgatgattttacttaccggcggcgcgatgctgttcttaatctctgggaagggcatcgggaagaccagcattggcctgatctgcgtcattgtctctagcggaatgctttggatggccgacgtgccactccagtggatagcatcagccatagtactggagtttttcatgatggtgctactcatccctgagccggagaagcagcgcactccccaggacaaccagctggcttatgtggtcatcgggatactgacgctcgccgcgatcgtcgctgccaatgagatgggcctcctggagacaaccaagcgcgacctaggtatgtcaaaggagcccggcgtggtgtcccctacaagctatctcgatgtagacctacaccccgccagcgcgtggacgttatacgccgtggcgaccacagtcatcacccccatgctacgccacacaattgagaactcgacggcgaacgtgagtttagccgccatcgctaatcaggcggtggtcttgatggggctggacaaggggtggcctatttccaagatggacctgggggtgccgttactggccctaggctgttactcccaagtgaaccccttaaccctgaccgccgctgtcctgctcctggtgacccactatgctatcatcggcccaggtctgcaggcaaaggccacccgagaggctcagaagcgcactgccgcgggaatcatgaagaacccaactgttgacgggataatgacgatcgatctcgacccggtgatctacgacagcaagttcgagaagcagctgggccaagtgatgctgctcgtgctgtgcgcggtccagctccttttgatgcggacctcttgggccctgtgcgaagccctcaccctggccaccggccccatcacgacactgtgggagggctccccaggcaagttttggaacaccaccatcgcagtctccatggccaacatcttccgcggaagctacctcgccggggccgggttggccttctccatcatgaagagtgttggcacgggcaagcgagggaccgggtctcagggtgaaactctgggcgaaaagtggaagaagaagctgaaccagttatcacgcagggagttcgagctgtacaagaagagtgggataacggaggtcgaccgcacggaggcgaaagaagggctcaagcgaggggagacgacgcaccacgcagtatccagagggagcgccaaactgcaatggttcgtagagcggaatatggttatccccgaaggccgcgtaatcgatctgggttgcggccgggggggctggtcctactactgcgccggtctaaagaaggtaaccgaagtccgggggtacaccaagggcgggccgggtcacgaggagcctgtgcccatgagcacctacgggtggaacacagtcaagctcatgtcgggcaaagatgtcttctatctgcccccagaaaaatgcgacacactgctgtgcgacataggcgaaagctccccctctcctacagttgaggagtcccggacgatacgggtattaaaaatggtcgagccctggctgaagaataaccagttctgcataaaggtactgaacccttatatgcccaccgtgatcgaacatctggagagactccagcggaagcacggcgggatgttagtcagaaatcctcttagtagaaactcaacgcacgagatgtattggatcagcaacggcaccggaaatatagtgtcctccgtgaatatggtaagccgcctgttgcttaatcggttcacgatgacccaccgccgcccaacaatcgaaaaagacgtggacctgggagccgggacccgacatgtgaacgcggaaccggaaaccccgaacatggacgttataggggagaggattaagcgtatcaaagaggaacactcgtcgacctggcactatgatgacgaaaatccctataagacgtgggcctaccacggatcatacgaggtgaaagcaacaggcagtgctagctccatgatcaacggcgtcgtgaagctcctgactaagccatgggacgttgtacctatggtaacacagatggccatgactgacactacgcctttcgggcagcaacgggtgtttaaagagaaagtcgacactcgtacgcctcggccgatgccaggcacccggaaggtgatggagattaccgcggaatggttgtggcggacactggggcgcaacaagcgacctcggctgtgcacccgagaggagttcaccaagaaagtgaggacgaatgccgccatgggagccgtttttaccgaggagaatcagtgggagtccgcccgcgccgcggttgaagacgaggaattttggaagctggtggggcgggagcgcgagctccacaagctgggcaagtgtgggtcatgcgtctacaacatgatgggcaagcgggagaagaaattgggcgagttcggtaaggcaaagggctctcgtgccatctggtacatgtggctcggtgctcggtacctggagttcgaggcccttggcttcttgaacgaagatcactggttcagcagagagaacagctactcaggcgtggaaggcgagggcttgcacaagctggggtacattctgcgggatatctccaagatacctgggggggccatgtacgccgacgacactgctggctgggataccagaattaccgaggacgacctccacaacgaggagaagataacgcaacaaatggaccccgagcaccggcaactggcgaacgctatctttaaattgacctaccagaacaaggtggtgaaggtgcaacgacccacacccaagggcacggtcatggacataattagtcgaaaggatcagcgcgggtcgggacaagtcgggacctacggcctaaacaccttcacgaacatggaggcccagctgatccgccaaatggaaggggaaggagtattaagcaaggctgacttggaaaacccccatctcctcgaaaagaaaattactcaatggctggagacgaagggcgtagagcgcctgaagcggatggccatttccggcgatgattgcgtcgtgaagccgatcgatgaccgcttcgccaacgccctcttggccctcaatgacatgggcaaggtgaggaaagacatcccgcagtggcagccctcaaagggttggcacgattggcagcaggtccccttctgtagccatcactttcatgagcttatcatgaaagacggccgcaagctggttgtgccctgccgtccccaggatgagctgatcggccgcgcccgtatctcgcagggagccggttggtccttgaaggagaccgcgtgtttgggaaaggcgtacgcccaaatgtggagtctcatgtacttccaccgccgcgatctgcggctggcgtccaacgcgatctgcagcgccgtgcccgttcattgggtgccaacgtcccgaaccacctggagcatccacgcacaccatcagtggatgaccaccgaggacatgctgaccgtttggaaccgcgtttggatcgaagacaatccatggatggaggacaaaacgcctgtaaccacctgggaagacgtaccctacctgggcaagcgtgaagaccagtggtgcggtagcttaatcggtctgacctcccgggccacgtgggcccagaacatcttgaccgcgatccagcaagtacgcagtcttatcggagacgaggagttcctcgactacatgccgtctatgaagcgatttcgcaaggaggaggagtcggaaggagctatctggtga

SEQ ID NO: 26149 - RNA, 9873 nt, synthetic construct
  misc_feature 1..9873: note = derived and/or modified CDS sequence (opt11) from DENV-3__KJ622196__SS-prME
  source 1..9873: mol_type = other RNA
acgtctttgtgcttgatgatgatgctccccgccaccctggcgtttcacctaaccagccgtgatggggaaccccggatgatagtcggtaagaacgaacggggcaagagcctgctgttcaagaccgcgagcggcattaatatgtgcaccctcatcgcaatggacttgggcgaaatgtgcgacgacaccgtgacctacaagtgccccctgattgccgaagtggagccggaagatatcgattgctggtgcaacttgacctccacctgggtaacctacgggacatgcaaccaggccggcgagcacaggcgcgacaagagatccgttgcgcttgcgccgcacgtgggcatggggctggacacccggacccagacctggatgtcagccgagggtgcctggagacaggtggagaaggttgaaacgtgggcactccgtcaccccgggttcaccatattagcactgttcctggcccactacatcggtacctcccttacccagaaggtggtaatcttcatactcctcatgctggttacgccgagcatggccatgcggtgcgtgggcgtgggtaaccgcgatttcgtcgaggggctgtccggcgccacctgggtggacgtggtgctcgagcacgggggctgcgtgaccacgatggcgaagaacaagccgacgctagacatcgaactccagaaaacagaggctacacagctcgccaccctgcggaagctgtgcatcgagggcaaaataacgaacatcacaaccgacagcagatgtcccactcagggcgaagccatcctgccggaggagcaagaccagaattacgtgtgcaagcatacgtacgtcgaccgtgggtggggcaacgggtgcggccttttcgggaagggttcccttgtgacctgcgcaaagttccagtgcctcgagagcatcgaggggaaggtggtccagcatgaaaacctgaaatacaccgtgaccatcacggtacacaccggtgaccagcaccaggttggcaacgacacccaaggggtgaccgcggaaatcacgcctcaggcgtccaccgtggaggctatcctgccggagtacggtaccctggggctggagtgcagcccccgaactggcctggactttaacgagatgatcctcctgaccatgaagaataaagcctggatggtgcatcggcaatggtttttcgatctgccccttccgtggacgtcaggcgccataaccgagacgcccacgtggaatcgcaaagaactgttggtgactttcaagaatgcgcatgcgaagaagcaggaggtggtcgtgctcggtagccaggagggcgccatgcatactgccttaaccggggccaccgagatacaaaattccggagggacctctatattcgccgggcaccttaaatgccggctcaagatggacaagctagaactgaaaggcatgtcatacgcgatgtgcctcaatacctttgtcctgaagaaagaagtttcggagacccagcacgggaccattctgatcaaagtggaatacaagggggaggacgccccatgcaagatcccgtttagcacggaggacgggcagggcaaagcccacaacggcaggctgatcaccgccaaccccgtcgtgacgaagaaggaggagcccgtgaatatcgaagcggagcccccattcggggagagtaatatcgtcatcgggatcggagataaggccttgaagatcaactggtacaaaaagggttcttccattgggaagatgttcgaagcgaccgcccgtggcgcgagacgcatggcgatcctgggcgacacagcatgggatttcgggagcgttggcggtgtgctgaactccctcgggaagatggttcatcagatctttgggtcagcctacacagccctgtttggcggcgtctcctggatcatgaagatcgggatcggcgtactgcttacctggatcgggttaaatagtaagaacacctccatgagctttagctgcattgtgattggcatcatcacgctgtacctcgggaccgtggttcaggccgatatgggctgcgtcataaactggaagggcaaagagctaaaatgtggtagcggaattttcgtgaccaacgaagtgcacacctggacggagcagtacaagttccaggcggactcccccaagaggctggccaccgccatcgctggggcgtgggaaaacggtgtctgcgggatacgtagcaccacccggatggaaaacctcctgtggaagcagatcgctaacgagctgaactacattctctgggagaacaatattaagctgactgtagtggtcggcgacatcatcggcgtgcttgagcaggggaagcgcactttgacgccacagcccatggagttgaaatactcctggaagacctggggcaaggcgaaaatcgtgaccgcagagattcagaacagctccttcatcatcgatgggccgaacacccccgaatgtccctccgcatcccgcgcttggaatgtctgggaggtggaggactacggattcggcgttttcacgacaaacatctggctaaaactaagagaggtgtacacgcagacctgtgatcaccggctgatgagcgctgctatcaaagatgaacgcgccgtgcacgccgacatggggtactggatagagagccagaagaatgggtcctggaagctggagaaggcgagctttattgaggtgaagacctgtacctggcccaagagccacaccctctggagcaacggggtcttagagtccgatatgattatccccaagagcctggccggccccatctcacagcacaaccatcgtcccgggtaccacacccagaccgcgggcccatggcacttaggcaagctggagctggatttcaactactgtgaagggacgacggtggtgatcacggaaaactgtggcacccgggggccttcactacggaccaccacagtctccggcaagctgatacatgaatggtgctgtcgaagctgcaccctgcccccgctacggtatatgggtgaggacggctgctggtacggcatggagattcgaccaatcaacgagaaggaggagaacatggtgaagtccctggtctcggcagggtccggcaaggtcgataatttcacgatgggcgtgctgtgcctcgccatcctattcgaggaggtgatgcggggcaaatttgggaagaagcatatgatcgcgggggtattactcaccttcatgcttttactaagcggccagataacgtggcgcgatatggcgcacaccttaataatgatagggagcaacgccagcgaccggatgggcatgggggtgacctacctggctctcatagccacctttaagatccaaccctttctagcgctgggattcttcttaaggaagctgacgtcccgggaaaacctgctcctgggtgttgggctagctatggccacaaccttacagttgcctgaggacatcgaacagatggccaacggcatcgctttagggttaatggccctgaagctgattacccagtttgagacgtaccaactatggaccgcgctagtctccctgacatgcagcaacacgattttcactctaaccgtagcctggcgcacggccacgcttatcttggcgggagtttccctcctacccgtctgtcagagcagtagtatgcggaagacggactggctaccagtggcagtggccgcgatgggggtgccgcccctccccctgttcatcttctccttgaaggacaccctcaaacgcagatcttggccgctgaacgaaggcgtgatggctgtcggattagtttcgatcctcgcgagctcactgctgcggaacgacgtccctatggcgggcccgttggtcgccggcgggctcctgatagcctgttacgttatcaccgggacaagtgctgatctcactgttgagaaggcggccgacgtgacttgggaggaggaggccgagcagacaggggtgtcccataatctgatgataaccgtagacgacgacggtacgatgcgcataaaagacgacgagacggagaatatcctgactgtccttctgaagaccgccctcctcatcgtgagtgggattttcccttattccatcccagccacacttctggtctggcacacttggcagaagcaaacccaacggtctggggtcctctgggatgtacccagcccgccagaaacccagaaggcagaactggaggagggtgtgtaccggattaagcagcaagggattttcggcaagacccaagtcggggtaggcgtgcaaaaggagggtgtcttccatacgatgtggcacgtcacgcgcggggccgtgctaacccataacggcaagcgcctggagcccaactgggcctccgtcaaaaaggacctgatcagttacgggggcggctggcggctgagtgcccagtggcaaaagggagaggaggtccaggtaatcgcggtcgagccaggccgcaacccgaagaattttcagaccatgcccggaatcttccagacgaccaccggcgaaatcggggctatcgccctggactttaagccggggacctcgggcagccccatcatcaatcgggaggggaaagtggtcggcctctacgggaacggcgtggtgacgaagaacggagggtacgtgagcggcatagcccaggccaatgcggaacccgacggacctaccccagagctggaggaggagatgttcaagaagaggaaccttaccatcatggatttgcaccccggcagtggaaaaacccggaagtacctgcccgccattgtccgtgaagccattaagaggcgtctgcggacattgatcctagcccccacaagagtcgttgccgctgagatggaggaggccctgaagggcctcccaatccgatatcagaccactgcgaccaagtctgagcacaccggtcgcgagatagtcgatttaatgtgtcatgccacctttaccatgcggttactcagccccgtgcgcgtgcccaactacaatctgatcatcatggatgaagctcattttacggatccagcttcaatagccgccagagggtacatttcgactcgcgtggggatgggggaggccgctgccatcttcatgaccgcaactcctcccggcacggccgaggccttcccacagtccaacgcgccgatccaggatgaggaacgcgacatccccgaacggagttggaacagcgggaacgagtggatcaccgacttcgtgggcaaaacggtgtggtttgtgccttcaattaaggccgggaacgatatcgcaaactgcctgcgcaagaacggcaagaaggtcatacagcttagccgtaaaaccttcgacacggagtatcagaagaccaagctgaacgactgggacttcgtggtgacaaccgatatttccgagatgggcgcgaatttcaaagccgaccgcgtgattgacccccggcgctgcctgaaaccggtgatactcacggacgggcccgagcgggtcattctggcaggccccatgcccgtcaccgccgccagcgccgcgcaacgcagaggccgagtgggccggaacccgcagaaggaaaacgaccagtatattttcaccggccagcccctgaacaacgatgaggaccacgcgcactggaccgaggccaagatgctcttggacaatataaacacacctgaaggcataatcccggcactgttcgagccggagagggagaaatccgcagcgattgacggcgagtataggcttaagggggagtctcgcaaaacgttcgtcgagcttatgcggcgcggcgacttacctgtgtggctcgcccataaggtagcctcagaggggattaagtacaccgatcggaagtggtgcttcgacggtgagcgcaataaccaaatcctggaggagaacatggacgtggagatctggacgaaagaaggagagcgcaagaaacttcgcccccgctggctcgatgcccggacctactctaaccccctggcacttaaagagtttaaggatttcgcggccgggagaaaaagcatcgccctcgacctggtcacggagatcggacgggtccctagccatctagctcaccgcactcgcaacgctctcgacaacctggtgatgttgcatacttccgagcacggtggaagggcgtataggcacgccgtggaggagctccccgagaccatggaaactcttctgctccttggactgatgatactcctaaccggcggggccatgctttttctgatctccgggaagggcataggtaaaacctccatcggcctgatatgtgtaatcgtgtcctcaggtatgctgtggatggccgacgtgcccctccagtggatcgccagcgcgatcgtccttgagttcttcatgatggtgctcctgattccggagcccgagaagcagcgcactcctcaggacaaccagctcgcctacgtggtgatcggcatcctgacgctcgcggccatcgtggccgcgaatgagatgggtctactggagaccaccaagcgtgacctcggcatgagcaaggagccgggcgtcgtctcaccgaccagctacctggatgtggatctgcatcccgcctccgcatggactctctacgctgttgctaccacagtcataacccccatgctgcgccacacgatcgaaaacagcaccgccaatgtcagcctagcagcgattgccaaccaggcggtggtcctcatggggctggacaagggctggcccataagcaagatggacctgggtgtgccgctcctggccctgggttgctactcccaggtcaaccccctcaccctgaccgccgccgtgctgctactcgttacacactacgcgataatcggccccggactgcaggcgaaggcaacccgggaagcccaaaagcgcaccgcagccggcatcatgaaaaacccgactgttgatgggataatgacgatcgacttagatccggtgatctacgatagcaagttcgagaaacaactaggccaagtgatgctgctagtcctttgcgcggtacagcttctcctgatgcggacgtcgtgggccctgtgcgaagccctgacgctggcgacgggccctatcacaacgctgtgggaggggagcccaggcaagttctggaacaccaccattgcggtgtccatggcaaatatattcagagggtcctatctcgccggtgctgggctggcattttccatcatgaagtccgtaggcacgggcaagcggggcaccggctcccagggggagactcttggcgagaagtggaaaaagaagctaaaccagctgagccgccgggagttcgagctctacaaaaagtctgggataaccgaggtagatagaacagaggcgaaggaaggtctcaagcggggcgagacaacccatcatgccgtgtcccgggggagcgccaagttacagtggttcgtggagcggaacatggtcatccccgaaggccgcgtgatcgatcttgggtgcggccgcgggggctggtcgtattactgcgccggcctcaagaaggtgaccgaggtccgggggtataccaaaggagggcctggccacgaggagcccgtccccatgtcgacgtacggatggaatacggttaagctgatgtccggcaaggacgtattctacctcccgcccgagaagtgtgacaccttactctgtgacataggggagagctccccctcccctacagttgaagagtcccgtacgatccgggttctcaagatggtcgagccctggctcaaaaacaaccagttctgcatcaaggtgctcaacccgtacatgccgaccgtgattgaacacctcgagaggctccagcgtaagcacgggggcatgctggtgcggaacccgctaagccgtaattctactcatgagatgtactggatcagcaatgggaccgggaatatcgtgtcaagcgtgaatatggtgagccgcctgctcttgaacaggttcaccatgacccaccgccgacccaccatcgagaaggacgtggacctgggtgctgggacccgccacgtcaatgctgagccggaaacccccaacatggacgtgataggtgagcggataaagcgcatcaaggaagaacacagctccacctggcactacgacgacgaaaacccatataaaacctgggcctaccacggtagctatgaagtgaaggccactggctccgccagcagcatgataaatggcgtcgtgaagctattgacaaagccgtgggacgtggtcccgatggtcacccacatggcaatgaccgacaccacgcccttcggccagcagcgggtgttcaaagaaaaagtcgacacccgcacgccacgaccgatgcccggtacccgcaaggtaatggagatcaccgcggaatggctgtggcggacgttaggcagaaacaagcgcccccggctgtgtaccagagaagagttcaccaagaaggtccggacgaacgctgccatgggcgcagtatttaccgaggagaaccagtgggaatctgcgcgcgccgccgtggaagacgaggagttctggaagctggtgggacgggaacgcgagttacacaagctgggtaagtgcgggagctgcgtctacaacatgatgggcaaacgggaaaagaagttaggcgagttcggcaaggccaagggttcccgcgccatatggtacatgtggctcggggcgcggtatctagagttcgaggccctgggcttcctcaacgaagaccattggttcagccgcgagaactcctatagcggtgtggaaggcgagggcctgcacaagctggggtacatcctacgagacatcagtaagatccccggcggggcaatgtacgccgatgataccgctggctgggacacacggatcacggaggacgacctgcacaatgaagagaagattacacagcagatggacccggagcaccgtcaactggcgaacgccatattcaaacttacataccagaacaaggtggttaaggtgcagcgccccacgcccaagggcacggtgatggacattattagccggaaggaccagagggggagcggtcaagtcgggacctacgggctgaacactttcaccaacatggaggctcagttaatcaggcagatggagggcgagggggtgctcagcaaggcagaccttgaaaacccccacctcctcgagaagaagatcacccaatggctggagacgaagggcgtagagcgcctgaaaaggatggccataagtggggacgactgtgtcgtcaagccaatcgatgatcgcttcgcgaacgctctcctggcccttaacgacatgggcaaggtgcggaaagacatcccacagtggcagcccagcaaggggtggcacgactggcagcaagtacccttctgttcgcatcacttccacgaactcattatgaaagacgggcgcaagttagtggtaccatgccgcccccaggacgagctgatcgggcgtgcccgcatctcccagggcgccggctggtccctcaaggagaccgcctgcctggggaaggcctatgcccagatgtggtcgcttatgtacttccaccggcgcgatctcaggctggcgtccaacgccatttgcagcgccgtcccagtacactgggtgcccacctccaggaccacctggagcatccacgctcaccatcagtggatgacgaccgaggatatgctgaccgtctggaacagggtgtggattgaagataatccgtggatggaggacaagacgccagttaccacctgggaggatgtgccctacctagggaagagagaggaccaatggtgcggtagtctgatcgggttgacgtcgcgggccacgtgggcccagaacatcctcaccgcgatccaacaggttcgcagcttgatcggcgacgaggagttcctggactacatgccctcgatgaagcggttcaggaaggaggaagaatccgagggagccatctggtag

SEQ ID NO: 26150 - RNA, 9873 nt, synthetic construct
  misc_feature 1..9873: note = derived and/or modified CDS sequence (opt11) from DENV-3__KJ830751__SS-prME
  source 1..9873: mol_type = other RNA
accagcctgtgcctcatgatgatcctgcccgccgccctcgcgttccacctcaccagccgggacggagagccgcgtatgatcgtggggaagaacgaacggggcaagagcctgttatttaagacggccagcgggattaacatgtgtaccctcatcgccatggatctgggcgagatgtgcgacgacaccgtgacttacaagtgcccacacatcacggaggtggaacccgaagacatcgactgttggtgcaaccttaccagcacctgggtgacttacgggacgtgcaaccaggcgggcgagcaccggcgcgacaaacggtccgtcgcacttgcgccccacgtgggaatggggttggacacgcgcacccagacctggatgtccgccgagggcgcgtggcgccaggtggagaaggtcgagacgtgggccctgcgccacccggggttcaccattttggcgctgttcctggcccactacatcggcacctccctcacccagaaggtggttatcttcatcctgctgatgcttgtcacgccaagcatgaccatgcggtgcgtaggggtcgggaaccgcgacttcgtcgagggcctgtccggggcaacctgggtggacgtggtgctggagcacggcgggtgtgtcaccacgatggccaagaacaagcccaccctcgacatcgagctgcaaaagaccgaggccacccagctggcgacgctccgcaagctgtgcatcgaagggaagatcaccaacatcactaccgacagccgctgccccacgcagggagaggccgttctcccggaagagcaggaccagaactacgtctgcaagcacacctacgtggaccgcgggtggggcaatgggtgcggattgtttgggaagggctccctggtgacttgtgccaaatttcagtgcctggagcccatagagggcaaggtcgtgcagtacgagaacctcaagtatactgtgatcatcaccgtccacactggggaccagcaccaggtggggaacgagacccagggggtcaccgcggagatcacgccccaggccagcaccaccgaggccattctgcctgagtacggcaccttagggctcgagtgctccccgcggacgggcttagacttcaacgagatgatcctgctcacgatgaagaacaaggcctggatggtgcaccggcagtggttcttcgacctgcccctgccctgggccagtggcgccactaccgagacgcccacttggaatcgcaaagagctcctggtgacctttaaaaacgcccacgcgaagaagcaagaagtcgtcgttttggggtcccaggagggcgccatgcacaccgccctaactggggccacggaaatccagaactcaggcgggacctccatctttgcgggccacctgaaatgccggctgaagatggacaagctcgagctgaagggcatgagctatgcgatgtgcaccaacaccttcgtcctgaagaaggaggtgagcgagacgcagcacgggaccatcctgatcaaggtggagtataaaggggaggatgccccgtgcaagatccccttcagcaccgaggacggacagggaaaagcccacaacggccgcctgatcactgccaaccccgtcgtgacgaagaaagaagagcccgtgaacatcgaggcggaaccgcccttcggagagtctaatatcgtcatcggcatcggggacaacgccctgaagataaactggtacaagaagggctccagcatcgggaagatgtttgaggccacagccagaggagcccgccggatggctatcctaggtgacaccgcctgggactttgggtccgtgggcggggtgctgaacagcctgggcaagatggtacatcaaatcttcgggtccgcttacaccgccctgtttagcggcgttagttgggtgatgaagatcggcatcggtgtcctcctcacatggatcggcctgaatagcaagaacacatccatgagcttctcctgcatcgcgatcgggatcatcaccctctacctcggcgctgtggtgcaggccgacatggggtgcgtcatcaactggaaaggtaaggagctgaagtgcggttcagggatcttcgtcaccaacgaggtgcacacgtggaccgagcagtacaagttccaggccgattcgccgaagcgcctcgctaccgcgatcgcgggagcttgggagaatggggtctgcggcatccgtagcactacgaggatggagaatctgctgtggaagcagattgccaacgagctcaactatatcctgtgggagaacaatatcaaactcaccgtggtagtcggggacactataggcgtgctggagcagggcaagcgcaccctgacgccccagccaatggagctgaagtactcctggaagacctgggggaaagccaagattgtgaccgcagagacccaaaacagcagtttcatcatcgacggccccaatacgccggagtgtcccagcgcgtccagagcttggaacgtctgggaggtggaggactacgggttcggcgtgttcaccacaaacatctggctcaagctgcgggaggtctacacccagctgtgcgatcaccggctgatgagcgccgcggtgaaggatgagcgcgcggtgcacgccgacatgggctattggatcgaatctcagaagaacgggtcctggaagctggagaaggcctcactgattgaggtcaagacctgtacgtggccaaagtcccacaccctctggtcaaatggtgtgctggagagtgacatgatcatcccaaagagcctggccgggcccatctcacagcacaactaccggccgggctaccacacgcagaccgccggcccctggcatctcgggaagctggagctcgactttaactactgcgaaggcacgaccgtggtcataaccgagagctgcgggacccgcggcccctccctccggaccaccaccgtgtccgggaagttgatccacgagtggtgctgccggtcctgcaccctgccccctctcaggtacatgggcgaagacgggtgctggtacggaatggaaatacgcccaataagcgaaaaagaggagaatatggtgaagtccctggtgagcgcaggctccggtaaggtggacaatttcacgatgggcgtgctgtgcctcgccattctgtatgaagaggtcatgcgagggaagtttggcaagaaacacatgatcgccggcgtcttcttcaccttcgtcctgctcttgagcggccagatcacgtggaggaacatggcacacaccctgatcatgataggctcaaacgccagcgaccggatggggatgggtgtcacatatctcgcgctgatcgcgacgttcaagattcagcccttcctggccctcgggtttttcctgcgcaagctgaccagccgggagaacctcctgctgggcgtgggcttagccatggcgaccactctgcaactgcccgacgacatcgaacaaatggccaatgggatcgccctcggcttgatggccctgaagctcatcacccagttcgagacctatcagctctggactgccctggtgtccctcacgtgcagcaacacaatgttcaccctgactgtagcttggagaacggccaccctgatccttgccggggtgtccctactgccggtgtgccagagctccagcatgcggaaaactgattggctccccatggcagttgccgcgatgggtgtgccgcccctgccgctgttcatcttcaacctcaaggataccctgaagcgccgctcctggcccctgaacgaaggggtcatggccgtcggcctcgtgtccatcctggcatccagcctgctccgcaatgacgttccaatggccggaccgttagtggccggaggcctgctcatcgcgtgctacgtgataacgggcacctccgcggatcttaccgtggagaaggccgccgatgttacttgggaggaagaggccgagcagacgggtgtgtcgcacaacctaatgatcaccgtcgacgatgatgggaccatgcgcataaaggacgacgagatcgagaacatcctcaccgtcctactgaagaccgcgctgttgatcgtgtctggtatcttcccatacagcatccccgccactctgcttgtctggcacacctggcagaagcagacccaacggtccggcgtgctgtgggacgtgcccagcccgccagaaactcagaaggccgaactggaggagggtgtctaccgcatcaaacagcagggcatcttcgggaagacccaggtgggcgtgggggttcagaaggagggcgtgttccacactatgtggcacgtgacacggggcgccgtcctcacccacaacgggaagcgcctcgagcccaactgggcgtccgtgaaaaaggacctgataagctacggcgggggatggcggctctccgcgcagtggcagaagggggaggaggtgcaggtcatcgccgttgagcccggcaagaaccccaagaatttccagacgatgcccggcaccttccagacgacaacgggagagatcggagcgatcgctctggacttcaagcccgggaccagcggcagccccatcatcaaccgcgaagggaaagtggtcgggctgtatggcaacggggtggttaccaagaacggcggctatgtatccggcatcgcgcaaaccaacgccgagccagacggccctacgccagagctggaggaagagatgttcaagaagcggaacctcacgattatggacttgcacccgggcagcggcaaaacccgcaagtacctgccagccatcgtacgggaggccatcaagcgtcggctccgcaccctgatcctggcccccacgcgtgttgtcgcggccgagatggaggaggcgctaaagggtttgcccatcagataccagaccaccgccaccaagtccgagcacacgggcagggagatcgtcgatctgatgtgccacgccaccttcacaatgcgcctcctgtctcccgtccgggtcccgaattacaacctgataatcatggatgaggcgcacttcaccgatcccgcctccatagccgcccgggggtacatctctacgcgggtgggcatgggggaagcagctgccatcttcatgaccgccacgccgccagggaccgccgatgcgtttccgcagtcaaacgcccccatccaggacgaagagcgcgacatccccgagcgtagctggaactccggcaacgaatggatcacagactttgccgggaagacggtctggttcgtcccctcgatcaaggccggcaacgacatagccaactgcctccggaagaacgggaagaaggtgatccagcttagccgcaagacattcgacaccgaataccagaagacgaaactgaacgactgggacttcgtggtcaccacggacattagcgagatgggcgcgaacttcaaagccgatcgggttatcgacccgcgccggtgcctcaagcccgtaatcttgaccgacggtcccgagcgcgtcatcctggctgggcctatgccggttacggccgcctcagcggcccagcggcgcggccgggtagggaggaacccccagaaggagaacgaccagtacatcttcaccggccagcccctaaacaacgacgaggaccatgcgcactggaccgaagcaaagatgctgttggataacataaacactcccgagggaatcctgccggcgctattcgagcccgagcgtgagaagtccgccgctatcgacggcgagtaccgcctgaagggcgagtcccggaagaccttcgtcgagctaatgcgcagaggggatctgcccgtctggctggcccacaaagtcgctagcgagggcatcaaatacacagaccgcaaatggtgcttcgacgggcagcggaataaccagatcttggaggagaacatggacgtggagatatggacaaaggagggcgagaagaagaagcttcgcccccggtggctggacgcgaggacctactctgacccgttagctcttaaagaatttaaagacttcgcggccggccgcaagagcatcgcgctggacctcgtaaccgagatcgggcgagtcccatcccatctggctcaccgcacgaggaacgccctggacaatctcgtgatgctgcacaccagcgaacacggcgggcgggcctaccggcacgccgtggaggagctgcctgagaccatggagactctgttgttactcggcctgatgatcctgctcaccggcggggccatgctgttcctgatctctggcaaggggatcggcaagacctccatcggacttatctgcgtcatcgcgagctccggcatgctgtggatggcagaggtgccgctgcaatggatcgccagcgcgatcgtgctcgaattcttcatgatggtcctgctgatccccgagcccgaaaagcagcgaacgccccaggacaaccagctagcctacgtggtgatcgggatcttgaccctggccgcgatcatcgccgcaaacgaaatgggccttttagagacgacgaagcgggacctgggcatgtccaaggagcccggcgtcgtgagccccacctcctacctcgacgtggacctgcaccccgcgagcgcctggaccctgtacgccgttgccactacggtgattacccccatgctccgccacaccatagaaaactccacagccaacgtgagcctagcggccatcgccaaccaggcagtcgtgcttatgggcctcgacaaggggtggccgatctccaagatggacctgggcgtgcccctgttggccctgggatgctacagccaagtcaacccactgaccctcacggcggccgtgttgctgctcatcacccactacgctataatcggccctgggctgcaggccaaggccacgcgcgaggctcagaagcgcaccgccgctgggatcatgaagaacccgacagtggacggcatcatgaccatcgacctggaccccgtaatctacgattccaagttcgaaaagcaactcggccaggttatgctgctggtgctctgcgccgtccagctgctgctcatgcggacgagctgggcgctgtgcgaggccctgaccctcgcaaccggccccatcaccacgctctgggagggctcccccgggaagttctggaacaccaccattgccgtgtcgatggccaatatcttcagaggctcctacctcgcgggggccggcctcgccttctcaatcatgaagtccgtggggaccggcaagcggggcacggggagccagggcgaaacacttggggagaaatggaagaagaagctgaatcagctctctcgcaaggagttcgacctgtacaagaagtccggcataaccgaggttgatcggaccgaagccaaggaagggctgaagcgcggcgagaccacgcatcatgccgtgagccggggcagcgcgaaactccaatggttcgtggagaggaacatggtcgttccggaagggcgggtcatcgacctgggctgcgggcgcggagggtggagctactactgtgccggcctcaaaaaggtgacagaagtgcggggctacactaaaggagggcccgggcacgaggagcccgtgcccatgtctacctacggctggaacatcgtcaagttgatgagcgggaaggacgtgttctacctgccgcccgagaagtgcgacacgctgctgtgcgacatcggcgagtcctcgccctccccaaccgtagaggagagccgcaccatccgcgttctcaaaatggtggagccgtggctgaagaacaaccagttctgcatcaaggttctgaacccgtacatgcccaccgtcattgaacatctcgagcggctgcaacgcaagcacggcgggatgctggtgagaaaccccctttcccgcaacagcacccacgaaatgtactggatttctaacggcaccgggaacattgtaagctccgtcaacatggtgtcacggctgctgctcaaccgcttcactatgacccaccggcggccgacgatcgaaaaggacgtggacctgggcgccggcacccgacacgtaaacgccgagcccgagacccccaacatggacgtgatcggggagcgcatcaaaaggatcaaagaggagcataactccacctggcactacgacgacgagaacccatacaaaacgtgggcctatcacggcagctatgaggtcaaggctaccggatccgccagcagtatgatcaacggcgtggtgaagctgttgaccaagccctgggacgtcgtgcccatggtcacccagatggccatgacggacaccacaccattcgggcaacagcgcgtgttcaaggagaaggtggacacccggacgccccgccccatgcccggcacccggaaggtgatggagataaccgccgaatggctgtggagaaccctgggccggaacaagcgaccccggctctgcacccgcgaggagttcaccaagaaggtccgcaccaacgcggccatgggagccgtgttcaccgaggagaaccagtgggactccgccaaggccgcagtggaagacgaggagttttggaagctggtcgaccgggagcgcgagctgcacaagttaggcaaatgcggcagctgtgtttataacatgatgggcaagcgggagaagaagctgggtgaattcggcaaggccaagggctcccgcgccatctggtatatgtggctcggggcccggtacctcgagtttgaggccctgggcttcctcaacgaggaccactggtttagccgcgagaactcctacagcggggtggagggcgaggggctccacaagctggggtacattctgcgggacatctcgaagatccctggcggggcgatgtacgccgacgatacggccggctgggacacccgcatcaccgaggatgacctccacaatgaggagaagatcatccaacagatggatcccgagcaccgccagctcgcaaacgcgatcttcaagctaacctaccagaacaaggtcgtaaaggttcagcgccccacgcccaccgggacagtaatggacatcatcagccggaaggaccagcgcggctccggccaagtcggaacctacggcctcaacactttcacgaacatggaggcgcagctggttcggcagatggagggggagggcgtcctgaccaaagccgacctcgagaacagccacctccccgagaagaagatcactcagtggctggagaccaagggggtggagaggctgaagcggatggcaatctccggggatgactgtgtggtcaagcccatcgacgaccgcttcgccaacgccctggtagcgctgaacgacatgggaaaggtgcgaaaggacatcccccagtggcagcccagccgcgggtggcacgattggcagcaggtcccgttctgctcccaccacttccacgagctcatcatgaaggacggccggaagctggtggtcccgtgccggccccaggacgagctgatcgggcgggccaggatcagccaaggcgccgggtggtccctccgcgagacggcctgcctgggcaaggcctacgcccagatgtggagcctgatgtactttcaccggcgcgacctccgtctggcttcaaatgccatctgcagcgccgtccccgtgcactgggtgccgacctctagaaccacctggtctatccacgcccaccaccagtggatgacgaccgaagacatgttaaccgtctggaaccgggtgtggatcgaggagaacccgtggatggaggacaaaacccccgtgacgacttgggagaacgtaccctacctcggcaagcgcgaggaccagtggtgcgggagcctgatcggcctgaccagcagggccacctgggcgcagaatatcccgacagccatccagcaggtccgcagcctcatcgggaacgaggaattcctggactacatgccttctatgaaacggttccgcaaagaggaggagtccgagggtgccatatggtga

SEQ ID NO: 26151 - RNA, 9873 nt, synthetic construct
  misc_feature 1..9873: note = derived and/or modified CDS sequence (opt11) from DENV-3__KC762681__SS-prME
  source 1..9873: mol_type = other RNA
acatcgctgtgcttaatgatgatgctgcccgcaaccctcgccttccatctcacctcccgcgacggcgaaccccggatgatcgtggggaaaaacgagcgcggcaaatccttactgttcaaaaccgcgtccgggatcaacatgtgtactctcatagccatggacctgggcgaaatgtgtgacgacactgtgacatacaagtgccccctaatcactgaggtggagcctgaggacatcgactgctggtgcaacctcaccagcacctgggtgacctacgggacgtgtaaccaggcaggggaacaccggcgcgataagcggagtgtggccctggcgccccacgttgggatggggctggacacccgcacccagacatggatgagcgcggaaggcgcttggcggcaagtcgaaaaagtcgagacctgggcctttcgccaccccgggtttactatcctcgccctgttccttgctcattacatcggcacctccctcacgcagaaagttgtgatttttatcctattgatgttggtcacaccctcgatgacgatgagatgcgtgggggtgggcaatcgcgacttcgtggagggcttatcaggggccacctgggtggacgtagtgctggagcacggcggctgcgtaacgaccatggcgaagaacaagcccaccctcgacatcgagctgcaaaagacggaagccacacagctggcgaccctccgaaagctgtgcatagagggcaaaatcaccaacgtgaccacggacagccgctgccccacccagggcgaggcgattttacctgaagaacaggaccagaactacgtctgcaagcatacctacgtcgacagaggctggggcaacggatgtggccttttcgggaagggctccctggtgacctgcgccaagttccagtgccttgagtttattgagggcaaagtagtacagcacgagaacctcaagtatacggtgatcatcaccgtccacacgggggaccagcaccaggtgggcaacgagacccagggggtcacggcggaaatcacgccgcaagccagcaccgtggaggccatccttccggagtatggcaccctggggctcgagtgcagcccccgcaccggcctggacttcaacgagatgatcctcctcacgatgaagaataaggcgtggatggtgcaccggcaatggttcttcgatctgccgttaccctggacaagcggcgcaacaaccgagacacccacctggaacaagaaggagctcctcgttaccttcaagaacgcccacgccaagaaacaggaggtcgtcgtcctgggtagccaggagggagcgatgcacacagcgcttacgggggccaccgagattcagaccagcggcgggacgtcgatctttgccggccatctgaagtgccgcctgaaaatggacaagctcgagctgaaaggcatgtcttacgcgatgtgcctgaacgccttcgtactcaagaaagaggtgtccgagacgcagcacgggactattctgatcaaggtcgaatacaagggcgaggacgccccgtgcaaaatcccgttctccaccgaggatgggcagggcaaagcccacaacggccggttgattaccgcgaacccagttgtgacgaagaaggaagaacccgtcaacatagaggcagagcccccgttcggggaaagcaacatagtgataggcatcggggacaaggcactgaagatcaactggtacaagaaaggttcctccatcgggaagatgtttgaggccaccgcccgcggagcccgtcgcatggccatcctcggtgacacagcgtgggatttcggctccgtgggcggtgtcctgaacagcctgggcaagatggttcaccaaatcttcggttccgcctacaccgctctcttcagcggtgtgtcctggattatgaaaatcgggataggggtcctgctgacgtggatcggcttgaacagcaagaacacctctatgagcttttcctgtatcgtgatcgggatcatcaccttatatctgggcgcagtggtccaggcggacatggggtgcgtgatcaactggaaaggcaaggagctcaagtgcggcagcgggatcttcgtaaccaatgaggtccacacgtggaccgagcaatacaagttccaagcggattcccctaagcggctggctaccgcgatcgccggcgcctgggagaacggggtgtgcggcatacgctcaacgactcgtatggagaacctgctctggaagcagatcgcgaacgagctgaactacatcttatgggagaacaacatcaagttaaccgtggtcgtgggcgatataatcggcgtgctggagcagggcaagcgcaccctgacgccccagcctatggacctcaagtattcctggaagacatgggggaaagcaaagatcgtcaccgccgaaacccagaacagctccttcataatcgacggtccgaacacacccgagtgccccagcgcctccagggcgtggaatgtttgggaggtggaggactacgggttcggcgtcttcacgactaacatctggctgaaactgcgggagatgtacacccaactctgcgatcaccgactgatgagcgctgccgtgaaggacgagcgggccgtgcacgcagatatgggctattggatcgagagccagaagaacgggtcgtggaagttagaaaaggcgtctctcatagaagtcaagacttgtacgtggcccaagtcccacacgttgtggtccaacggcgtactagagtccgacatgataatccccaagtcgctcgcaggacccgtttcccagcataactaccggcccggatatcacacgcagaccgccgggccgtggcacttagggaagctcgagctcgacttcaactattgcgagggcaccacggtggtgatcaccgagaactgcgggacccgggggcctagcctgcgaaccacgaccgtttccgggaaacttatacacgagtggtgctgcaggagctgcaccctgccgcccctccgctacatgggggaagacgggtgctggtacggcatggagatccggccgatcaacgagaaggaggagaacatggtcaagtccctggtgagcgcgggctcaggaaaggttgacaacttcactatgggtgtcctctgcctggcaatcctgttcgaggaggtaatgcgcgggaagttcggcaagaagcacatgatcgcgggggtcctgtttacgttcgtcctgttactctccggacagatcacgtggcgggacatggcccgcaccctgatcatgatcggctcgaacgcaagcgaccgtatgggtatgggcgtgacctacctcgccctaattgcaacgttcaaaatccaacccttcctggcgctagggtttttcctccgtaagctgacctcccgggagaacctcctcctgggcgtgggcctggcaatggctaccacactgcagctacccgaagacatcgagcagatggccaacgggatcgcgcttggactcatggccctgaagctaataacccaattcgagacataccagctttggaccgcgttagtcagcctgatgtgcagcaacaccatgttcacactgaccgtggcctggcgcaccgctacactgatcctggccgggatctcgttactgcccgtctgccagagctccagcatgcgcaagacggactggctgccggtgaccgtagctgccatgggcgtgccgcccctcccgctgttcatcttctccctgaaggataccctcaagaggcgtagctggccgctgaacgagggcgttatggccgtaggcctggtctcaatcctagccagcagcctcctgcggaatgacgtgcccatggcggggcccctcgtggccggtgggctgcttatagcctgctacgtcatcaccgggactagcgccgacctcaccgtggagaaggccgcggacgtgatctgggaggaggaggccgaacagaccggtgtctcacacaacctgatgatcaccgtggacgacgacgggacgatgcggatcaaggacgatgagacagaaaacattttgaccgtgctcctgaaaaccgccctgctcatcgtatctggcatcttcccctactccatcccggccacactgctggtgtggcacacgtggcagaagcagacccagcggagcggcgtgctctgggacgtccccagcccgcctgagacccagaaagccgagctggaggagggggtgtaccgcattaagcagcagggcatcttcgggaagacccaagtgggtgtaggggtccagaaggagggcgtgtttcacactatgtggcacgtcacccggggcgctgtactgacccacaacgggaagcgcctcgagccgaattgggccagcgtcaaaaaggatctgatctcatatgggggcgggtggcgcctgtcggcccagtggcaaaagggggaggaggttcaagtgatcgccgtggaacccggcaaaaacccgaaaaacttccagaccatgccgggcatcttccagactaccaccggggagattggcgcgatcgccttagacttcaagccaggcacctccggcagtcccatcatcaaccgggagggcaaggtggtggggctttacggcaacggggtcgtcaccaaaaacggagggtacgtcagcggtatcgctcagactaatgccgaaccggacggcccgacaccagagctagaggaggagatgtttaagaagcggaacctgaccatcatggacctccaccccgggtccggcaagacgcgcaagtacctgcccgccatagtccgggaggcgatcaaacgccggctgcgcacccttatcttggccccgacgcgcgtcgtggccgcggagatggaggaggccctgaaggggctccctatccgctaccagaccaccgcgaccaaaagcgcgcacactggcaaagagatcgtagacctgatgtgccacgccacctttacaatgcgactgctctctcccgtccgcgtgcccaactacaacctgatcatcatggacgaggcccatttcaccgatccggccagcatcgcggccagggggtacatctccacccgcgtgggcatgggggaagcggctgcgatctttatgaccgccacgccgcccgggaccgccgacgccttcccccaatcgaacgcccccattcaggatgaggagcgggacatcccggagcgctcctggaacagcggcaacgagtggatcaccgacttcgcggggaaaaccgtatggtttgtgccatccattaaggccggcaacgacatcgccaattgcctgcgcaaaaacgggaagaaggtgattcagctaagccgaaagacgttcgacaccgagtaccagaagactaagctgaacgactgggactttgtcgtgactacggacatctctgaaatgggcgcaaacttcaaaaccgatcgcgtgatagatccccggcgctgcttaaagccggtaatcctcaccgacggcccggagcgcgtgattctggctgggcccatgcctgttaccgtagcgtccgccgcacagcgtcggggccgcgtggggcggaacccgcagaaggagaacgaccagtacatcttcacgggccaacccctgaacaacgatgaggaccatgcccactggaccgaggccaagatgctcctggacaacatcaatacccccgaaggtatcataccggcgttattcgagccagagcgggagaagtctgccgctatcgacggtgagtaccggctaaagggcgagtcgcgtaagaccttcgttgagctcatgcgccgcggggacctgccggtatggctcgcccacaaggtggcgagcgagggcatcaagtatacagaccggaagtggtgcttcgacggggaacgcaacaaccagatactggaggagaatatggacgtcgaaatctggacgaaggagggagagaagaagaagctgcggccgcgctggctcgacgccagaacctacagcgaccccctggccctgaaggagttcaaggactttgctgccggtcgcaagagtattgcccttgacctggtgaccgagatcgggagggtgccctcacatctcgcgcaccggacccgcaatgccctggataacctggtcatgcttcacacgtccgagcacggagggcgggcctaccgccacgccgtggaggagctgcccgagaccatggagacccttctgctcctgggcctgatgatcctcctgacagggggcgcgatgctgttcctcatcagcggcaaggggatcggcaagacgagtatcgggctgatctgtgtggttgccagttcagggatgttatggatggccgatgtccccctccaatggatcgccagtgccatagttttagagttcttcatgatggtcttgctcataccagaacctgaaaagcagcggacgccgcaggacaatcagctggcgtacgtggtgatcgggatcctgacccttgccgcgatcgttgccgccaacgagatgggccttctcgagaccacaaagcgcgacctcggcatgtctaaggagccgggggtggtgtccccgaccagctacctggacgtcgacctgcaccccgcgtccgcttggacactctatgccgtcgcaaccacggtaatcaccccgatgctgaggcacacgatcgagaactccaccgcgaacgtctccctcgccgccatcgcgaatcaggccgtcgtgctcatgggattagacaagggatggcccatctcgaaaatggacctgggagttccgctcttagcgttggggtgctactcccaggtgaatccactcactttaactgccgcggtgttactcctggtcacccactatgctataatcggccccggcctgcaggccaaggcgacccgcgaggcacagaagcgaactgccgccgggatcatgaagaaccccaccgtggacggcattatgaccatcgatctcgacccagtgatctacgacagcaagtttgagaagcaactggggcaagtcatgctgctcgtgctgtgcgcagtgcagctactcctcatgcgcaccagctgggcgttctgcgaagccctgacgctcgccaccggccccatcaccacattgtgggaaggcagccccgggaagttctggaacacgaccatcgccgtctctatggcgaacatcttccggggtagctacttagccggggcaggcctcgccttctccatcatgaagagtgtggggaccggcaagaggggcaccgggagtcaaggcgagaccctgggcgagaagtggaagaagaaactgaaccagctcagccggaaggagttcgacctctacaagaaatccggcatcaccgaggtggatcgcaccgaggccaaggaagggttaaagcggggcgagattacccaccacgcggtgtcacgcggcagcgctaagctccaatggttcgtggagcggaacatggttatccccgagggccgcgtcatcgacctgggctgcgggcgcggcggatggtcctactactgcgccggcctgaagaaggtgacggaggtgcggggctatacgaagggaggaccggggcacgaggagccggtacccatgtctacgtacggctggaacatcgtgaagctcatgtccgggaaggacgtgttctaccttcccccggagaaatgcgacaccctgctgtgcgatatcggcgagagttccccctctcccacggtagaggagtccaggacgatccgcgtgctcaaaatggtggagccctggctgaaaaataaccagttctgcatcaaggtcctcaacccgtacatgcccaccgtgatcgagcacctggagcgcctgcaacgaaaacacggcggtatgctggtgaggaaccccctgagccggaactccacccacgagatgtactggatcagcaatggcaccggcaacatcgtctcctctgttaacatggtttcccgcctgctactgaatcggtttacgatgacgcaccgccggcccaccatcgagaaggacgttgacctgggcgccggcacgcgccacgtcaacgcagaaccggagacgccgaacatggacgtcatcggtgaacggatcagacggatcaaggaggaacactcttccacttggcactacgatgaggaaaacccctacaagacctgggcgtaccacggatcatacgaggttaaggccaccgggagcgccagcagcatgatcaacggcgtggttaagctgttaacgaagccatgggacgttgtgcccaccgtcacccagatggctatgaccgacacgaccccctttgggcagcaacgcgtgttcaaagagaaagtggacacccggacgccccggccaatgcccggcacccggaaggctatggagatcaccgcggaatggctgtggcgcaccttggggaggaacaagcgaccacggctctgcacccgggaggagtttactaagaaggtccgcacaaacgccgccatgggggctgtgtttactgaggagaatcagtgggattccgctagggccgctgtggaagacgaggagttctggaagctggtcgaccgcgaacgggagcttcataagctaggaaagtgcgggtcctgcgtgtataacatgatgggcaagcgcgagaagaagctgggggagttcggcaaggccaagggcagccgggccatctggtatatgtggctgggtgcgcgctacctggagttcgaagccctggggttcctgaatgaagaccactggttcagccgggagaacagtttctctggggtggagggcgaggggctgcacaagctgggatacatcctgcgcgacatctcgaagatccccggcggggccatgtacgcggacgataccgccggctgggacactcgaatcacagaggacgacctccacaacgaggagaagatcacccagcaaatggacccggagcaccgccaactcgcgaacgccatttttaagttgacatatcaaaataaggttgtgaaggtgcaacgccccacgcctaaggggaccgttatggatatcataagccgcaaggaccagcggggctcaggtcaggtgggaacttacgggctcaacaccttcaccaacatggaggtccagttgatccgtcagatggagggggagggcgtcctgagcaaggccgacctcgagaacccacaccttctcgagaaggagatcacgcagtggctcgagaccaagggggtcgagcggttgaaacgcatggctatttccggcgacgactgcgttgtaaagcctatcgacgaccggttcgccgacgcactgctcgccctgaacgacatgggcaaggtgcgcaaagacatcccccagtggcaaccaagcaaggggtggcatgattggcaacaggtcccgttctgctcccaccacttccacgaactgattatgaaggacggccggaagttagtcgtgccttgtcgcccccaagacgagctgatcgggcgggctcgcatttctcagggcgccggttggtccctgaaggagacggcctgcctcggcaaggcgtacgctcagatgtgggcgctgatgtacttccaccgccgggacctgcgcttagccagcaacgcgatctgctccgccgtacccgtccactgggtgccgaccagccggacgacctggtccatccacgcccaccaccaatggatgaccaccgaggatatgctgacggtgtggaatcgcgtttggatagaggataacccttggatggaggacaagacaccggtgaccacatgggaggacgtcccataccttggcaaacgggaggaccagtggtgcgggagcctcatcggattagccagccgcgccacgtgggcgcaaaacatcctgaccgctatccagcaagtccggtccctcattgggaacgaggagttcctggactacatgccaagcatgaaacgcttccggaaagaggaggaatccgagggggccatttggtga

SEQ ID NO: 26152 - RNA, 9873 nt, synthetic construct
  misc_feature 1..9873: note = derived and/or modified CDS sequence (opt11) from DENV-3__KC762684__SS-prME
  source 1..9873: mol_type = other RNA
acttccctgtgtctcatgatgatgttaccggcgaccctagcatttcacctgacctcacgtgacggtgaaccccgaatgatagtcgggaaaaacgaaagaggaaaaagcctactcttcaaaacggcatccggcatcaatatgtgcactctcatagcaatggaccttggtgaaatgtgcgacgataccgtgacgtacaaatgcccattgatcaccgaagtcgaaccggaagatatagactgctggtgcaatctgacttcgacgtgggttacatacggcacatgcaatcaagcaggagaacataggcgtgacaaacgtagcgtcgccctagcgcctcacgtcggaatgggactggacacgcgcgcacagacatggatgagcgccgaaggggcttggcgccaggtggaaaaggtggaaacgtgggcgttcaggcatcccggtttcaccatacttgccctatttctagcacattatataggcaccagcctaacacaaaaggtagtgatattcatactattaatgttagtgacaccgtcaatgactatgaggtgtgtgggtgtaggcaaccgagactttgtagaagggttgtccggcgctacgtgggtcgacgttgtactggaacacggagggtgcgtaaccacgatggccaaaaacaagccaacactggatattgaattacagaagaccgaggccacacaactagcgacgctgcgtaaactatgcatcgaaggaaagattaccaacgtaacaacggatagtaggtgcccaacgcaaggcgaagcaatactacctgaagaacaggaccaaaactatgtctgcaagcacacctatgtcgacagaggctgggggaacggctgcggcctgttcgggaaaggatccctagtgacctgtgcgaaattccagtgcttagaactcatcgaagggaaagtagtacaacacgagaacctaaagtacaccgtctcaataacagtccacacaggggaccagcaccaagtgggcaacgagacgcaaggggtgaccgcggagatcacgccacaggcaagcaccgtggaagccatactgcccgaatacgggacactcggactagagtgcagccccaggacaggattggattttaatgaaatgatactactaacaatgaaaaacaaggcatggatggtacatagacaatggtttttcgaccttccattgccctggacctcaggcgccacaaccgagaccccaacatggaacaagaaagaattgctagtaacattcaagaacgcgcacgccaagaaacaggaggttgtggtcctgggctcacaagaaggcgcgatgcacaccgcactcaccggtgccacagagatacagacgagcggtggcacttcaatcttcgccggccacttaaagtgccggctaaagatggacaaacttgaactcaaggggatgagctacgcaatgtgtagcaatgccttcgtactcaagaaagaggtcagcgagacacaacatgggacgatcctaatcaaggtcgaatacaaaggcgaagacgcgccctgcaaaataccgtttagcacggaagatggccaaggaaaggctcacaatggacggctaataacagcaaaccctgtggtaacgaaaaaggaagaaccggtcaacatcgaagcggaaccacctttcggggaatccaacataatcataggtattggcgacaaggcactcaaaatcaactggtacaagaaagggtcgagtatcggcaagatgttcgaggcgaccgcacgcggggcgagaagaatggccatactcggggatacagcatgggattttgggagcgttgggggcgtgctgaactcattaggaaaaatggtacaccaaatattcggaagcgcctacaccgcattattcagcggagttagctggatcatgaagatagggataggagtgctactcacctggataggactcaactcgaagaatacgagcatgagcttctcctgcatcgtgataggaataataactttgtaccttggcgcggtcgttcaagcggatatgggatgcgtcatcaactggaagggaaaagaactaaagtgtggctcagggatcttcgttaccaatgaagtacacacttggactgagcagtacaaattccaggccgactcccccaagcgtcttgccacagcgatagcaggcgcttgggaaaacggcgtctgcgggataaggagcacgacacgcatggagaacctactctggaaacaaattgcaaatgaactgaactacatcctgtgggagaataacattaaactgacagtggtagtgggcgatataatcggaatcctggaacagggcaaacggaccctcaccccacagccaatggagctgaaatacagttggaaaacatggggcaaagccaagatcgtgaccgcagaaatgcaaaactcctcgttcatcatagacggccccaatacaccagagtgcccgaacgccagtcgcgcatggaacgtatgggaagtcgaggactatgggtttggcgtatttaccacaaatatctggctgaagctccgggaaatgtacacacagctatgcgaccaccgactaatgagcgcagctataaaagacgaacgagcagtgcacgcggatatggggtactggatcgaatctcaaaagaacggtagctggaaattagagaaagcatccctcatcgaagtgaaaacatgcacgtggcctaagtcccacacactttggtcaaatggggtgcttgaaagcgatatgattataccaaaatccctcgccggaccaataagtcaacacaattacaggccaggatatcacacccaaacagcaggaccctggcacctcggaaaactagaactagactttaactactgcgaggggactaccgtcgtcataaccgaaaattgcggcacgagaggcccctcactgcgaaccacgacggtctccggcaaactcatccatgagtggtgctgcagatcgtgtaccctaccccctctaagatacatgggcgaagacggctgctggtacggcatggaaatacggcctataaacgaaagagaagagaacatggtgaaaagcctcgtgagtgctggatcgggaaaagtggacaactttaccatgggagtcctttgcctagcgatcttattcgaggaggtcatgcgtggaaaatttggcaaaaagcacatgatcgccggtgtgttcttcacgttcgtacttctactcagtggccaaataacctggcgcgacatggccaggacattaataatgattggaagcaatgcatctgatcgaatgggtatgggcgtgacctacctagcgctcatcgctactttcaaaatccaaccatttctcgcactagggttctttcttaggaaacttacttcccgagagaatctgctgctcggagtggggctagcaatggctaccaccctgcaactcccggaagacatcgaacaaatggcaaacggaatagcgttaggactaatggccctgaagctggtaacacaattcgaaacataccagttatggaccgccctcgtcagcctaatgtgctccaatactatcttcacactcaccgtagcatggcggaccgccacactaatactagcaggaattagtcttctaccattatgtcaaagttcggggatgagaaagaccgactggttaccaatgactgtggccgccatgggggtaccacccctaccgctatttatcttctcgttaaaagacacactaaagaggcgctcatggcccttaaacgaaggcgttatggcggtagggctcgtctccatactcgcgagtagcctgctccgcaacgacgtaccaatggcgggccccctagtagcagggggcctccttatagcctgttatgtaatcaccgggactagcgctgacctcaccgttgagaaggcagctgacgtcacgtgggaggaggaggcagagcagacgggggtaagccataacctgatgataacagtggatgacgacgggactatgagaataaaagatgacgaaactgaaaatattctcacggtgcttctaaagaccgcactattgatagtaagcggaatcttcccctatagcatcccagccacattgttagtatggcacacatggcaaaaacagacacaacggtcaggggtcctatgggacgtcccatcccctcctgaaacacagaaagcggaattagaggagggcgtctataggataaaacagcaagggatattcggaaaaacacaagtgggcgtaggagtgcaaaaggagggggtatttcatacgatgtggcatgtgacgaggggagcagtgctcacttataacggaaaacggctggagcccaactgggccagcgtaaagaaagacctgattagttacgggggtgggtggagactgtctgcgcagtggcaaaaaggcgaagaggtccaggtcatcgcggttgagccagggaaaaatcccaaaaatttccaaaccatgccaggcatctttcagactaccacaggcgaaataggggccatcgcgctggacttcaagccagggacttcgggctccccaatcattaacagagaaggaaaagtagtcgggttatacgggaatggcgtcgtcaccaaaaacggaggctacgtatccggcatcgcccagacgagtgccgaaccggatggcccgacgccagagctagaagaggaaatgttcaagaaacgcaatctcaccatcatggacttacacccaggatcgggaaaaactcgtaaataccttcccgctatcgtgcgcgaagcaatcaaacgccgcctgcgtacgctaatcctagcccctacccgggtagttgcggccgagatggaagaagcactaaaaggattaccaatacgctaccaaaccaccgctaccaaaagcgagcacaccggaaaggagatagtcgacctaatgtgccacgcaacctttaccatgcgactgctctcgccagtaagagtgcccaattacaacctaatcataatggacgaagcccacttcaccgatccggcctcaatcgcggcaagaggctacatcagcaccagagtgggcatgggagaggcagcagcgatctttatgactgctacaccacccggtaccgcagacgccttcccgcagtcgaatgccccgatacaggacgaggaaagagacataccagaacgctcctggaactcggggaacgattggatcaccgactttgctggcaagacagtctggtttgtcccaagcattaaggcgggcaacgacatcgcaaattgcttgcgaaagaacgggaagaaagtaatacaactatcacgaaaaacgttcgacacggaataccagaaaacaaaactaaatgactgggatttcgtggttacaacagacatctcagagatgggagcgaacttcaaagcggaccgggtcatagacccgagaagatgcctaaaaccagtgatcctaacagacgggccggaacgtgtaatcctagcgggcccgatgcctgtcactgtggcctcagccgcacaacgacgcggaagggtcggccgcaacccccaaaaagaaaacgaccaatatatattcacaggacaacccctaaacaacgacgaagaccacgctcattggacagaagccaaaatgctgcttgacaacatcaacacgccagagggcatcatccccgctctcttcgagcccgagcgagagaaatcggcagccatcgacggcgaataccgcctgaagggtgagtcccgcaaaacattcgttgagctcatgagaagaggcgatctgcctgtctggctcgcgcacaaagtagcatccgagggcatcaagtacacagaccggaaatggtgctttgatggtgaaaggaacaatcaaattctcgaagagaacatggacgtagaaatctggactaaggaaggagagaagaagaaactgaggccgcgatggctggacgctcggacctacagcgacccactagccttgaaagagttcaaagatttcgcggcaggacgcaaatcaatagcgttagacctagttacggagataggtcgcgtgccttcacacttggcccacagaacacgaaacgccttagacaacttggtaatgctgcacacatcagaacatggagggcgggcgtaccggcatgcggtcgaggaactaccagagacgatggagacgctgctattgttaggcctaatgatcttactcaccggcggagtcatgcttttcctaatcagcgggaagggggttgggaaaacatcaatcgggttaatctgcgtcgtagccagcagtagcatgctgtggatggcagacattccgctgcaatggatagcctcagcaatcgtcctagaatttttcatgatggtccttctaattccagaaccggagaagcaaagaacaccccaggataaccaactcgcatacgtagtgatcggaatcctcacactagcggccatcgtcgctgccaacgaaatggggctgttagagacaaccaaaagagacctcggaatgtcaaaagaaccgggagtggtgtccccaacctcgtatctcgacgtcgacctacatcccgcctccgcctggaccctctacgcagtggcaacaactgtaatcacccccatgttgcgacacacgattgaaaattctacagcaaatgtaagcctagcggccatcgcgaaccaagccgtggtcctaatgggattggacaaaggctggcctatatcaaaaatggatctgggcgtccctctcctagcactcggctgttactcccaagtcaacccactaacactaactgccgcagtactcctgctagtaacacactacgccatcataggaccgggactacaggccaaagcaacaagagaggcccaaaaacgcacggcagcagggatcatgaagaacccaaccgtcgacggcataatgacaattgatctagatccggtcatttatgattccaagttcgagaaacaactaggacaagtcatgctgctagtgttgtgcgcggtacagctcctactaatgagaaccagctgggcattctgcgaggccctgacgctcgcgacagggcccataaccacactttgggaaggatcaccgggcaagttctggaacacaaccatagcggtgtcgatggcaaacatcttccggggctcgtacctggctggtgcaggactggctttcagcatcatgaaaagcgtgggcactggcaagcggggaaccggatcacaaggagagacgttgggggaaaagtggaaaaagaaactaaaccagctttcccgtaaggaatttgatctgtacaagaagtcagggattactgaggtcgaccgaacggaagcaaaggaaggactaaagagaggggaaatcacccaccatgccgtctccagaggctctgccaaacttcaatggtttgtcgaacgaaacatggtgatacccgaggggagggtcattgatctgggctgcggacgcggcggatggtcgtactactgcgcgggactcaaaaaggtaacggaggtaagaggatacacgaaaggcgggccgggtcacgaggagcctgtcccgatgtccacctacggttggaatattgtaaaactcatgagcggtaaagacgtcttttatctgcctccggaaaagtgcgacacactcctatgcgatataggggaaagcagtccctcccccaccgtagaggaatcacgaacaataagggtcctcaaaatggtcgaaccgtggctaaagaataaccagttctgcataaaggtgctcaacccctacatgccggcggttatcgagcacctcgagcgcctccaaagaaaacacgggggcatgttagtcagaaacccgctatcgcggaacagcacacacgaaatgtactggatcagcaacgggaccggaaacatcgtctcgtctgtcaacatggtatcccgccttctactaaatcgctttacaatgacatacaggcgcccaacaatagagaaggacgtcgacctcggtgcgggcacgagacacgttaatgcagaaccggagacgcccaacatggacgtaatcggggagcgaattaggcgaatcaaagaagaacatagctcaacatggcattacgacgatgagaacccctacaagacttgggcataccatgggagctatgaagtcaaggcaactgggagcgctagttccatgatcaacggggtcgtgaaactattgaccaagccctgggacgtagttccaacagtaacccagatggccatgacagacacaactcctttcggacaacaacgcgtgtttaaagaaaaggtggatacacgtacaccaaaaccaatgccaggcacaagaaaagtaatggaaattactgcagaatggctctggcgcacattagggcgcaacaaaagacctcgcctatgcacccgtgaggagttcaccaagaaagtacgaacgaacgccgcgatgggtgccgtcttcacagaagaaaaccagtgggatagtgcgagagctgccgtagaagacgaggaattttggaaactcgtcgacagagaaagggagttacacaagttaggcaagtgcgggtcatgcgtttacaacatgatggggaaacgagaaaagaagttgggtgagttcgggaaagccaaaggatcgcgtgcgatatggtacatgtggcttggagcccgatacttggaatttgaagcactcggattcctaaatgaggatcactggtttagccgggaaaacagctactccggggtggagggcgaagggctacataagctgggttatatcctcagagacatcagcaagatccccggaggtgcaatgtacgcggatgacacagcaggatgggatacacgaatcaccgaagacgacctacataacgaagaaaagataacacagcaaatggacccggagcatcggcagctggctaacgcaatattcaaactcacataccagaacaaggttgtaaaggtccaacggccaactcccaaaggcacggtgatggacatcatctcacgaaaggaccaacgaggaagcggacaagtaggcacatacggcctaaataccttcaccaacatggaggcccagctaataagacaaatggagggtgaaggtgttctttcaaagaccgacctcgaaaatccccatctgctagagaagaagatcacacagtggctggaaacgaaaggtgttgaacgtttaaaaaggatggcaattagcggggacgactgcgtcgtcaaaccgatcgacgacagattcgcaaacgccttgctagccttgaacgacatgggcaaagtacgcaaagatatcccgcaatggcaaccgagcaaggggtggcacgactggcagcaagtccccttttgcagccaccacttccacgagctaatcatgaaagacggtaggaagctagtagtcccgtgccgaccgcaggatgagcttatcggacgagcacgcataagtcagggagcgggctggtcactcaaggaaacagcatgcctaggaaaagcatacgcgcaaatgtgggcactaatgtattttcataggagggacctacgactagcaagtaacgccatctgctcggcagtcccagtacattgggtaccaacctcccgcacgacctggagcattcacgctcaccatcagtggatgacaaccgaagatatgctgactgtatggaacagggtctggattgaagacaatccctggatggaggacaaaaccccggtcaccacctgggaagacgtgccctacctcggtaaaagagaagaccagtggtgcggcagtttaatcgggctgacgtctagagcaacatgggcacaaaacatacttacagcaattcagcaagtaagaagcctgataggaaatgaagagttcctggactatatgccgagcatgaagcgattcagaaaggaagaggaaagtgagggagcaatttggtaa

SEQ ID NO: 26153 - RNA, 9873 nt, synthetic construct
  misc_feature 1..9873: note = derived and/or modified CDS sequence (opt11) from DENV-3__KC762686__SS-prME
  source 1..9873: mol_type = other RNA
acctccctgtgcctcatgatgatgctccccgcaacactggctttccacctcacctctcgcgatggcgagccacggatgatcgtgggcaagaacgagcgcggtaaatccctgctgtttaagaccgcatctgggatcaacatgtgtacactcatcgccatggatctgggggagatgtgcgacgacaccgtgacgtataagtgccccctaataaccgaggtggagccggaagacattgactgctggtgcaacctcacttcaacatgggtaacgtacggtacgtgcaatcaggccggcgagcaccgccgcgataagcggtccgtggccctggctcctcatgtgggcatgggattggacacccgcgcccagacatggatgagcgccgaaggcgcctggcgccaagtagaaaaggtggagacttgggcattccgccatcccgggttcaccattctcgccttgttcctagcccactacatcggcacctccctcacccagaaggtggtgatattcatactgcttatgctcgttacacccagcatgactatgcgctgcgtgggggtcggcaatcgagattttgtcgagggcctgtccggggcgacctgggtggacgtggttctggagcatgggggttgcgttaccacgatggctaagaataagcctaccctcgacatcgagctgcaaaagaccgaggccacccaactcgcaacattgcggaaactgtgcatagagggcaagatcaccaatgtcacgaccgactcccgctgccctactcagggtgaggccatactcccggaggagcaagaccagaactacgtctgcaagcatacatacgtggatcgcgggtggggcaacgggtgtggtctcttcgggaagggcagtctggtgacctgcgccaagtttcagtgcctggagttcatcgagggcaaggtcgtgcagcacgagaacctgaagtacaccgtaattatcacggtccacacgggtgatcagcatcaggtgggcaacgagacccagggagtgaccgccgagatcacgccccaagcctcgaccgtggaagcgatacttcccgagtacggtaccctcggactggagtgtagcccccgaaccggcctggacttcaatgagatgatcttgctcaccatgaagaacaaggcctggatggtgcatcggcaatggttcttcgacctgcctctgccctggactagcggagccaccacggagacccccacgtggaacaagaaggagctcctcgttacctttaaaaacgcgcatgccaaaaagcaggaggtggtggtcctcgggtctcaggagggggcgatgcacaccgccctcaccggcgccacggagatccagaccagcggcggaaccagcatcttcgccggccacctgaagtgccgtctgaaaatggacaaactcgaactgaagggaatgagctatgccatgtgcctgaacgcgttcgtcctcaaaaaggaggtctccgaaacccagcacgggaccatcctaatcaaggtcgaatataagggcgaggacgcaccctgtaagatcccgttctccactgaggatggacagggcaaagcccacaacggacggctgatcacagcgaaccccgtggtgaccaagaaagaagaacctatcaacattgaggctgagcctccgttcggggagagtaacattgtcatcggcatcggggacaaggctctgaagatcaactggtacaagaagggatccagcatcgggaaaatgtttgaggcaacggctcgcggagcgcgacggatggcgattctcggcgacactgcatgggacttcggatccgtgggcggggtgttgaacagcttgggcaagatggtccaccagatcttcgggtccgcctacactgccctcttcagcggtgtatcctggatcatgaaaatcggtatcggggtgctcttgacatggatcggcctcaatagcaagaacacgtccatgagcttttcctgcatcgttatagggataataaccctgtaccttggagccgtggtgcaggccgatatggggtgcgtcatcaactggaagggcaaggagctcaagtgcggcagcggtattttcgtcactaacgaggtgcatacttggacggaacagtataagttccaggcggacagccccaaacggctggcaaccactatcgcgggcgcctgggaaaacggggtctgcgggatccgctcaaccacccgcatggagaaccttttatggaagcaaatcgcgaatgagctgaactacatactgtgggagaacaacattaagctcacagtagtggtgggagacatcatcggcgtgctggagcaaggcaagcggaccctgacgccccagcccatggagctcaagtactcctggaagacgtgggggaaagctaagattgtcaccgcggagactcagaactcatctttcattatcgacgggccgaacactcccgagtgtcctagcgcgagtcgcgcgtggaacgtctgggaggttgaggactacgggttcggtgtgttcacaaccaatatatggttaaagctaagagaaatgtacactcaactttgtgaccatcgcctgatgagcgcagctgttaaggacgagcgggccgtacacgctgatatgggttactggatagagagtcagaagaacggtagttggaagctcgagaaggcaagccttatcgaggtgaagacctgcacctggcccaagtcccacacgctttggagcaacggtgtcttagagtcggatatgatcatccccaagtcgctcgccggaccagtatcgcagcacaatcatcgccccggctaccacacccaaaccgcaggcccgtggcatctgggcaagctggagctcgacttcaactattgcgaggggaccacggttgtgatcaccgaaaactgcgggacccgcggaccaagcctgcgtactacgacagtctccgggaaactgatccatgagtggtgctgcagaagctgcaccttgccgcccctccgctacatgggggaggacgggtgctggtacgggatggagatccggccgatcaacgaaaaggaggagaatatggtgaagagtctggtcagcgccggatctgggaaggtcgacaacttcacgatgggcgtattgtgccttgccatcctgttcgaggaggtgatgcgcgggaagttcggcaagaagcacatgatcgcgggggttctgttcacatttgtgctgcttctctcagggcagatcacctggcgggacatggcccgcacactgatcatgatcggctccaacgccagtgaccggatggggatgggcgtcacttacctggcactcatcgcgaccttcaagatccagccattcctggcgcttggtttcttcctccgcaaattgacctccagagagaacctgttactcggcgtgggcctggccatggccactactctccaactgcccgaggacatcgagcagatggccaacggcatcgccctggggctcatggccttaaagctgattacgcagttcgagacctatcaactctggacagccttagtcagcctgatgtgcagcaacaccatatttacgctcaccgtggcctggcgcaccgcaacccttatcttggcggggatctcgttactgcctgtctgccagtcttcctcaatgcggaagacggattggttgcccgtcacagtggccgccatgggagtgccaccattgcccttattcatattctccctgaaagatacccttaagagacgaagctggccgctgaacgaaggggtcatggccgtaggtctggtgagtattctcgctagctccctgttaaggaacgacgtccctatggcggggcccctcgtagccggaggcctactgatagcctgctacgtgataaccggaacgtctgccgatttgaccgtggagaaggccgctgacgtgatctgggaggaagaggccgagcagaccggagtgagtcataacttaatgatcacggtcgatgatgacgggacgatgcgcattaaggacgacgagaccgagaatatcctgacagtgctcctcaagaccgcgctcctcatcgtctcaggcatctttccttactccatcccggctaccctcctggtctggcacacttggcagaagcagacgcagcggagcggggtgttatgggacgtgccttcgccccctgagacccagaaggccgagctggaggagggggtgtacaggattaagcagcaaggcatcttcgggaagacacaagtgggtgtgggcgtgcaaaaggagggcgtgtttcacacaatgtggcacgtgaccagaggggcggtcctgactcacaacgggaagcgcctcgagccaaactgggcctctgttaagaaggacctgataagttacggtgggggctggcggctaagcgcccagtggcagaaaggggaagaggtgcaagtcatcgcggttgagcccgggaaaaatccaaagaacttccaaaccatgcccggcatcttccagacgacgactggcgaaattggcgcgatcgcccttgacttcaaaccaggcacctccggctcacctataattaaccgcgagggcaaggttgttgggctttacggcaacggtgtggtgacaaagaacggcgggtacgtcagcggcattgcccagaccaacgccgaacctgatggccctactcccgagctggaagaggagatgttcaagaaaaggaacctaactatcatggaccttcatcccgggagcggcaagacccgcaagtatctccccgccattgtccgggaggcgatcaaacggaggctgcgcaccctcatcctggccccgactcgggtagtcgccgccgagatggaggaggccttaaagggattacccatccgttatcagaccacggcgactaagagcgctcacacaggcaaagagatcgtagaccttatgtgtcacgccaccttcaccatgcggcttctctccccagtgcgcgttcccaattacaatctgattatcatggacgaagcccatttcaccgacccggccagtatcgcggcacgtggctacatttccacccgcgtgggcatgggcgaggccgctgccatattcatgacagccacaccgccagggaccgcggacgcctttccccagagtaacgctccgatccaagacgaggagagagacatccccgaacgctcctggaacagcggcaacgagtggattaccgacttcgcaggcaagaccgtgtggttcgtaccgagcatcaaggccggcaatgacatcgccaactgcctacgcaagaacgggaagaaagttattcaattatcacgtaagacgttcgatacggaataccagaaaactaagctgaacgactgggacttcgttgtcaccacagacatctccgagatgggcgcaaacttcaaggcggaccgcgtgattgacccccggagatgcctgaagccggtgatacttactgatggcccggagcgtgtcatcttggcggggcccatgcctgttaccgtggccagcgctgcccagagacgaggccgcgtcggacgcaacccccaaaaggagaacgatcaatacatcttcaccggtcagccgttgaacaacgatgaggatcacgctcattggacggaggcgaagatgctattagacaacatcaacacacccgaggggatcatccccgccctattcgagcccgagcgcgagaaatccgctgccatcgacggggagtaccggctgaagggcgagagccgcaagacgttcgtggaactgatgcggcgcggagacttacccgtctggctcgcgcacaaggtggcctcagagggcattaagtacaccgaccggaagtggtgtttcgatggggaaaggaacaaccagatcctagaggagaatatggacgtagaaatctggaccaaggagggcgagaagaagaagttaaggccacgttggctcgacgcccggacgtactctgacccactggccctaaaagagttcaaggatttcgccgcgggccgaaaaagtatcgccctcgacctggttaccgagatcgggcgcgtgccgagccacctggcgcaccggactagaaatgcactcgacaatctggtgatgctacacacctccgagcacggagggcgggcctaccgccacgctgtcgaggagctcccggagacgatggagaccctgctgctactaggattaatgatcctcctgaccggtggggcaatgctgttcctcatctctgggaagggtatcggcaagacctcgatcggactgatttgcgtggtggcttccagcggcatgctgtggatggccgacgtacccctccagtggatagctagcgcgatcgtgctggagttctttatgatggtactgctcatacccgaacccgagaagcagcgtacgccgcaggacaaccagctggcgtacgtggtgataggaatcctgaccctcgccgctatcgtggccgcgaacgagatgggcctgttagagaccaccaagagagacctgggcatgagcaaggagcccggggttgtgtctcctacgtcttatctggatgtggaccttcacccagcttccgcttggaccctctatgccgtcgcaaccaccgtgatcactccgatgctgcgccatacgatcgagaactcaaccgctaacgtgtccctggccgccatcgccaaccaggccgtcgtattaatgggcttagacaagggatggccaatcagcaaaatggacctgggagtgccactcctggcgttggggtgttacagccaggtcaatccgctgacccttacggccgccgtgcttctcctggtgacccactacgccatcatcggcccgggcctgcaggcgaaggccacccgcgaggcccaaaaacggaccgctgccgggatcatgaagaacccaactgtcgacggcatcatgacgatcgaccttgacccggtcatctacgacagcaagttcgagaagcaactcggccaagtgatgctgctcgtcctatgcgcggtgcagctgctcttgatgcgcacctcctgggccttttgcgaggccctaaccctcgccacgggcccgatcaccaccctgtgggaggggtcccctgggaagttctggaatacaacgattgcggtctccatggccaacatcttccggggcagctatctggcaggggccggcctcgccttctccatcatgaagtcagtcggtacgggcaagcggggcaccgggtctcagggcgagacccttggagagaagtggaagaagaaattaaatcagctcagccggaaagagtttgacttatataaaaagtccggcataacggaagtggaccgcaccgaggctaaggaggggctgaagcggggcgagatcacccaccacgcggtgagtagagggtcagccaagctccagtggttcgtcgagcgaaacatggtgatacccgaggggagagtgatagacctaggatgtgggcggggcggttggtcgtactactgtgccggtctgaagaaggtcaccgaggttcgcggctacaccaagggcgggccgggacacgaagaacccgtacccatgagtacttacggctggaacattgtaaagttgatgtccgggaaggacgtattctatctgccaccggagaaatgcgacacgctgctgtgcgacatcggggaaagttccccctcgcccaccgtggaggaatcccgcaccatccgcgtattgaagatggtcgagccctggctgaagaataaccagttttgcatcaaggtgttaaacccatatatgcccacggtcatcgagcacctcgagcgcttacagcggaagcatggtgggatgctggtgcgcaatcccctcagcagaaactccacccacgaaatgtattggataagcaatggtactgggaacatcgtgtccagcgtcaacatggtgtcacgactactgctcaatcggtttaccatgacgcaccgtcggcccaccatcgagaaggatgtcgacctgggcgccggcacccgccacgtgaacgcggagccagagaccccgaacatggatgtgataggggagcggatccgccggataaaggaagaacatagctccacgtggcattacgacgaggagaacccatacaaaacctgggcctaccacggcagctacgaggtcaaggccaccgggtccgccagcagtatgataaatggcgtggtgaagctgttaaccaagccctgggacgtagtgcccacagtgacccagatggccatgaccgacaccacgcctttcgggcaacagcgggtcttcaaggagaaagtagatacccgaacgccccggccgatgcccggcactcggaaggccatggagatcaccgccgaatggttgtggcgcaccctgggccggaacaagcgcccccggctctgcacccgagaggaatttactaagaaagtccgcacaaacgctgccatgggggcggttttcacggaggagaaccaatgggactccgcccgggcagctgtggaggacgaggagttctggaagctggtggatcgcgagcgggagctccacaagctgggcaaatgcgggagctgcgtctacaacatgatggggaaacgcgagaagaagttaggagagttcggcaaggccaagggctcccgggcgatctggtacatgtggctgggcgccagatacctagagttcgaagccttaggcttccttaacgaggaccactggttctccagagaaaactcattcagcggcgtcgagggtgaggggctccacaagctaggctacatcctgcgtgacatttccaagatcccgggcggggccatgtacgccgatgatactgcgggctgggacacgcggattacggaggacgacctccacaacgaggagaagatcacacagcagatggagccggagcaccgtcaactcgccaatgcgatcttcaagctgacctaccagaacaaggtggtcaaggtccaacggcccacacctaaggggacggtaatggacattataagccgcaaagaccaacggggctcgggccaggtagggacctatggtttaaacaccttcaccaatatggaggtgcaactgatccgccagatggagggggagggcgtgttaagcaaagccgaccttgagaacccccacctcctggagaaggagatcacgcaatggctcgaaacgaaaggtgtcgagcggctgaagcgcatggccattagtggcgacgactgcgtggttaagcccatcgatgatagattcgctgacgccctactcgccttaaacgacatgggtaaggtccgaaaagacattccgcagtggcagcccagcaaaggttggcacgactggcagcaggtccccttctgctcccatcacttccatgaattgattatgaaggacggccggaagctcgtagtcccatgcagaccccaagacgagctgataggacgggcgcgcataagccagggcgccgggtggtctcttaaggagaccgcatgcctcgggaaggcctatgcgcagatgtgggccctaatgtactttcaccgccgggacctgcgcctagcgagcaatgccatctgcagtgccgtgccagtgcattgggtccccacatctcggaccacgtggtccatccacgcccaccaccagtggatgaccaccgaggacatgctaaccgtttggaaccgcgtatggatcgaggacaacccatggatggaggacaagactcctgtcaccacctgggaagacgtaccctacttaggcaaacgggaggaccagtggtgcggatcgctcatcgggctggctagccgcgccacctgggcccagaatatcttaacggccatccagcaggttcggtccctcatagggaacgaggagttcctggattacatgccttccatgaaacgcttccgtaaggaggaggaatcggaaggagccatctggtga

SEQ ID NO: 26154 - RNA, 9873 nt, synthetic construct
  misc_feature 1..9873: note = derived and/or modified CDS sequence (opt11) from DENV-3__KC762685__SS-prME
  source 1..9873: mol_type = other RNA
acgagcctgtgcctcatgatgatgctgccagctaccttagccttccacttgacctcccgggacggcgagcccagaatgatcgtcgggaagaacgagaggggcaagagcctgctgttcaagaccgcctccgggatcaacatgtgcacgctcatcgccatggacctgggcgagatgtgcgacgacaccgtgacgtataagtgccccctgatcaccgaagtggagccagaagatatcgattgctggtgcaatttaacatctacctgggtgacttacggcacctgcaaccaggccggcgagcaccgtcgcgacaagcggtccgtagccctggctcctcatgtcggcatggggctggacacccgcgcgcagacctggatgagcgcggagggcgcctggcggcaggtcgagaaagtcgagacatgggccttccgccaccccgggttcaccatcctcgcgttatttctggcacactacattggcaccagcctcacccaaaaggtggtgatcttcatcctgctgatgctcgtcacgcccagcatgaccatgcgctgcgtgggtgttggcaaccgcgacttcgtcgagggcctatcgggggccacgtgggtcgacgtggtcttggaacacggaggctgcgtgaccacaatggccaaaaacaagcccaccctggacatcgagctccagaagaccgaagccacccagctggcgacgctcaggaagctgtgcatcgagggcaaaatcaccaacgtgaccaccgacagccgctgccccacgcagggcgaggccatcttacctgaagagcaggaccaaaactacgtttgcaagcatacctacgtcgaccgtgggtggggcaatgggtgtggcctcttcgggaagggctccctggtaacctgcaccaaattccagtgcctggagttcatcgagggcaaggtggtgcagcacgaaaacctcaaatacacggtgataatcaccgtccacaccggggatcagcatcaagtgggcaacgagacccagggggtcacggccgagatcacaccccaagccagtaccgtggaggccatccttcccgagtacggaaccctggggctcgagtgcagcccccgcaccggcctggattttaacgagatgatcctgcttacaatgaagaacaaagcgtggatggttcaccggcagtggttcttcgacctgccgctgccctggaccagcggcgcaaccacggagacgccaacctggaacaagaaggaactcctggtcaccttcaagaacgcccacgccaagaagcaggaggtggtggtcctagggtcgcaggagggcgccatgcacacagcactcacgggggccaccgagatccaaacctctggcgggacctccatatttgccggacacctgaagtgccgactgaagatggataaactcgaactaaaggggatgagctacgcaatgtgtctgaacgccttcgtgctcaagaaggaggtctcggagactcagcatgggaccatcctaatcaaggtcgaatacaagggcgaggacgcgccctgtaagatcccgtttagcaccgaggacggccaaggcaaggcgcacaacggccgcctgatcacggccaatccggtggtgacgaagaaggaggagcccgtcaacatcgaggccgagcccccgttcggggagagcaacatcgtgatcggcatcggggacaaggccctgaagatcaactggtacaagaaaggctcctcaattggcaagatgtttgaagccactgcaaggggagcccggcgcatggccatcctcggcgacaccgcgtgggacttcgggtctgtgggcggagttctgaacagcctggggaagatggtacaccaaatattcgggtccgcttacacggccctcttttctggagtctcctggatcatgaaaatagggatcggtgtcctgctgacttggatcggactaaacagcaaaaacacctccatgtccttctcctgcatcgtgatcgggatcatcaccctgtacctcggagccgtggtacaggccgacatggggtgtgtgatcaattggaagggcaaggagctcaagtgcggcagcgggatcttcgtgaccaacgaggtccacacatggacggagcaatacaaattccaagcggactccccaaagcgactggccacggcaatcgccggcgcctgggaaaacggtgtgtgcggcatccgcagcaccacgcgcatggagaacttgctctggaagcagatcgccaatgaattgaactatattttgtgggagaataacatcaagctcaccgtcgtagtgggggacatcatcggcgtactggaacagggcaagcgcaccctgacgccccaacctatggagttgaagtactcctggaagacgtgggggaaagcgaagatcgtcaccgccgagacacagaacagctcctttatcatcgacggcccgaacacgcccgaatgcccctccgcctcccgcgcgtggaacgtgtgggaagtggaggactacggattcggcgtttttaccaccaacatctggttgaagctgcgggagatgtacacccaactctgcgaccataggcttatgagcgccgccgtgaaagacgagcgggcggttcacgctgacatgggctactggatcgaaagtcagaagaacgggtcttggaagttggagaaggcgagcctcattgaggtaaagacttgcacctggcccaagtctcacacgctgtggagcaacggtgtgctggagtccgacatgatcatccccaaatccctcgccgggcccgtttcccagcacaattaccgccccggttaccatacccagaccgccggcccgtggcacctagggaaactagagctcgatttcaactactgcgagggcacaaccgttgtgataaccgagaactgtggcacacggggccccagcttgcgcaccaccaccgtgtccgggaagctaatccacgaatggtgctgccggagctgcaccctgcctcctctccgctacatgggcgaggacgggtgctggtacggcatggagatccggccgattaatgaaaaggaggagaacatggtcaagtctctggtctctgccggctccgggaaggtggacaacttcaccatgggtgtcctctgcctggccatcctgttcgaagaggtgatgcgcggtaagttcggcaaaaagcacatgatcgcgggggtgctgtttacgttcgttctgctactcagcggccagatcacctggcgggacatggcccgcacactgatcatgatcggcagcaacgcctcggatcgaatggggatgggcgtaacctacctggccctcatcgcgacctttaagatccagcccttcttagcgctcgggttcttcctccgcaagttaacctccagggagaacctgctattgggcgtgggtctagcgatggcgactactctccagctgccggaggacatcgagcagatggcaaatggcatagcgctgggcctcatggccctgaagctgatcacgcagttcgagacctaccaactctggaccgccctcgtcagcctgatgtgcagcaacaccatcttcactctcaccgtcgcatggcgcaccgccaccctgatcctggcaggcatctccctcctcccagtctgccagagctccagcatgcggaagacggattggcttccggtgacggtggccgccatgggtgtgccacccctccccctgttcatcttcagcctcaaggacaccctcaagagacgctcatggccgctgaacgagggggtgatggcggtgggcttggtctcaatcctcgccagctccttgctgcggaacgacgtgcccatggcgggcccgcttgtagcagggggtctgctgatcgcctgctacgtgatcaccggaactagcgcggacctcaccgtggagaaggcagccgacgtgatctgggaagaggaggccgagcagacgggcgtctcccacaacctgatgatcacggtggacgacgacgggaccatgcgcatcaaagacgacgagaccgagaacatcctgaccgtcttacttaagaccgccctgctcatcgtctccggcatatttccatactccatccctgccactctgctggtgtggcatacatggcaaaaacaaacccagcggagcggcgtcctctgggacgtcccgtccccgcctgagacccagaaagccgagctcgaagaaggagtgtaccgcattaagcagcagggcatcttcggaaagacccaggtgggcgttggggtgcagaaagagggcgtcttccacacaatgtggcacgtcacccggggcgccgtactgacccacaacgggaagagactggaaccgaactgggcgagcgtgaagaaggatctaatctcctacggcggcggttggcggctgtcagcccagtggcagaagggagaagaggtccaggtgatcgccgtggagcccggcaagaatccgaagaacttccagacgatgcccggcatcttccagactaccaccggggagataggcgcaatcgccctggacttcaaaccgggcacctccggcagccctataatcaaccgcgagggaaaggtcgtcgggctctacggtaacggcgttgtcacaaagaacgggggctacgtcagcggaattgcccagaccaatgccgagcccgatggcccgacccccgaactagaagaagagatgtttaaaaagcggaacctgaccatcatggaccttcaccccgggagtggcaagacgcgcaagtacctgcccgccatcgtgcgggaggcgatcaagcgccggctgcgtactctcattctagccccaacccgggtagtggccgcggagatggaggaggcattaaaggggctccccatccgctaccagaccacggcgacgaagagcgcccacaccggcaaagagatcgtggacctaatgtgccacgccaccttcacgatgcggctgctctcccccgtccgcgtacccaactacaacctgatcatcatggacgaggcccacttcaccgacccggcctccattgcggcccgggggtacatctctactcgcgtgggtatgggagaggctgctgcgatcttcatgaccgccacgccgcccgggaccgctgacgccttcccccagagcaatgccccgatccaggacgaagagcgggacattccagaacgatcctggaactcgggcaacgagtggatcaccgacttcgcgggaaagaccgtctggttcgtgccctccatcaaggccggcaatgacatcgccaactgtctgcgcaaaaatggaaagaaagtcatacagctcagccggaaaacgttcgacaccgagtaccagaagaccaagcttaacgactgggacttcgtcgtgaccaccgatatctcagagatgggcgcgaacttcaaggccgaccgcgtgattgatccccgtcgctgcctgaagccggtcatactcacagacggccccgagcgcgtgatcctggctgggcccatgcccgtgacagtcgccagcgccgcccaacgccggggccgcgtggggaggaacccgcagaaggagaacgaccagtatatctttacaggccaacctctcaacaacgatgaggaccacgcccactggacagaggcgaagatgctcctggacaacatcaacacccccgaagggatcatccccgccttattcgagccggagcgggagaagtccgccgccatcgacggcgagtataggctgaagggcgagagcagaaagaccttcgttgagctgatgcgaagaggtgacctgcccgtgtggctagctcacaaagtagcctccgagggcatcaaatacaccgatcggaagtggtgctttgacggcgaacgcaacaaccagatcttagaggagaacatggacgtagagatctggactaaggagggcgagaagaagaagttacggccccgctggctggacgcgcggacttactcggacccgctggcgctgaaagaattcaaggactttgccgcgggtcgcaagtccatcgctctcgacctggtaactgagatcggtagagtcccttcccacctggcacaccggacacgcaatgccctggataacctggtgatgctccacacctccgagcacggggggagggcctaccgccacgcagttgaagagctccccgaaaccatggagactctgctgcttctaggcctgatgatcctcctgaccgggggcgccatgctgttcctcatcagcggcaaagggatcggaaagacctctatcgggcttatttgcgtggtcgcctctagcggcatgctgtggatggccgacgtgccgctccagtggattgcgtccgcaatcgtgctggagttcttcatgatggtcctgctcatcccggagccagagaaacagcggacgccccaggataaccagctggcctacgtggtgatcgggattctgaccctcgcggccatcgtagcagcaaacgagatgggcctgcttgagaccaccaagcgcgacctcggcatgagcaaggagcccggggtcgtgtctccgacgtcatacctggacgtcgacctgcacccggccagtgcctggaccctctacgccgtggctaccaccgtcatcactcccatgctgcggcacaccatagagaacagcaccgccaatgtctccctggccgccatagccaaccaagcggtggtactcatgggcctggacaagggatggcccatcagcaagatggacctgggcgtcccgctactggcactggggtgctactcacaggtgaaccccttgacccttacggcggccgtgctgctcctggtcacacactacgccatcatcggccccggcctgcaagcgaaggcgacgcgggaggcccagaagcggaccgccgccgggatcatgaagaacccgactgtggatggcatcatgaccatcgaccttgacccagtgatttacgacagcaagttcgaaaagcagttgggtcaggtaatgctcctcgtcctgtgtgcggtgcagctgttgctaatgaggacctcctgggctttttgcgaggcattgaccctagctacgggcccgatcaccaccctttgggaaggcagccctgggaagttttggaacacaacgatcgcggtgagcatggccaatatcttccggggcagctacctggcaggcgccggcctcgccttctccatcatgaaatccgtggggaccggcaagcgcggcacggggagccaaggggagaccctgggcgagaagtggaagaaaaagctaaaccagctcagccggaaggagttcgatctgtacaagaagtccggcatcacggaagtcgaccgtaccgaagcaaaggaggggctgaagcgaggcgagatcacccaccatgcagtctcaagaggctccgccaagctacagtggttcgtggagcggaacatggtgatacccgaggggcgcgtcatcgacttgggttgcggacggggggggtggtcctactactgcgccggcctgaagaaggtgaccgaggtacgcggctatactaagggggggccggggcacgaggaacccgtccccatgagcacctacgggtggaacatcgtgaagctcatgagcggaaaggacgtgttctacctgcccccggagaaatgcgataccctgctgtgcgatatcggcgagagctctccctcccccacagttgaggagtcccggaccatccgcgtgctcaagatggtggagccctggctgaaaaacaaccagttctgcatcaaagtccttaatccctacatgccgacggtgatagagcacctcgagcgcctgcagcgtaagcacggcggtatgctggtgcgcaaccctctcagccggaactccactcacgaaatgtactggatcagcaacgggaccgggaatatcgtctctagcgtgaacatggtgagtcgcctcctcctcaacaggtttacaatgacacaccgccggcccacaatcgagaaggacgttgatctgggtgcagggacacgccacgttaacgcggagccggaaacccccaacatggacgtgatcggtgagcggatccgccggatcaaggaagagcatagctcaacatggcactacgacgaggagaacccctacaagacctgggcctaccacggctcgtacgaggtgaaggccaccgggtccgcctctagcatgatcaacggggtggtaaagctcctcaccaaaccgtgggacgtggtgcctacggtcacccagatggccatgactgacaccactccattcgggcaacagcgcgtgttcaaagaaaaagtggacacccggacgccacgcccgatgccaggcaccagaaaggcgatggagattaccgccgagtggctgtggcgcaccttgggccggaacaagcgccccaggttgtgtacccgcgaggagttcacaaaaaaggtgcgcacgaacgccgcaatgggggcggtgttcaccgaggagaaccagtgggactccgcccgggccgcagtagaggatgaggagttctggaagctggtcgaccgcgagagggagctgcacaagctcggcaagtgcggcagttgtgtgtacaacatgatgggcaagcgcgaaaaaaaattgggggagttcggcaaggccaagggcagccgcgcgatctggtacatgtggttaggagcccgctacctcgagttcgaggcactgggcttcctgaacgaggatcactggttcagccgtgagaactccttttctggcgtcgaaggcgaagggctccacaagctgggctacattctgcgcgacatctccaagatcccaggcggggccatgtacgccgatgacaccgcgggctgggatacccggatcacggaggacgacctccacaacgaggaaaaaatcacccaacagatggagccggagcaccgccagctcgccaacgctatcttcaagctgacctatcagaacaaggtcgtaaaagtgcagcgtcccacccccaaagggactgtcatggacatcattagccgaaaggaccaaaggggcagcggccaggtgggcacctatggcctaaacactttcaccaacatggaagtgcaactgatcaggcagatggagggggagggcgtcctgagcaaggctgacctcgagaacccccatttactggagaaggagataacccagtggctcgagacgaaaggggtggagcggctgaagcgcatggccatctccggagacgactgcgtggttaagcccatcgacgaccggttcgcggatgccctgctcgccctgaacgacatgggcaaggtgcgcaaagacataccccagtggcagcccagcaagggttggcatgactggcagcaggtccccttctgttcccaccacttccacgaacttattatgaaggacggccgtaagttggttgtgccgtgccgtccccaggacgagctgatagggagagccagaatcagccagggggccgggtggtccctgaaagagaccgcgtgcctcggaaaggcctacgcccagatgtgggctctgatgtacttccaccgtcgggacctgcggctggcgagcaacgcaatctgttccgccgtccccgtccactgggtgccgaccagccggaccacctggtccatccacgcccaccaccaatggatgaccacggaggacatgctgacggtttggaatcgcgtctggatcgaggataacccctggatggaggacaagacgcccgtgaccacctgggaggacgtgccctacctgggcaagcgggaggaccaatggtgcgggtcactcattggccttgcaagccgcgcgacgtgggcccaaaatatcctgacggccatccagcaagtgcgctccctcatcgggaatgaggagttcctggattacatgccaagtatgaagcgcttccgaaaggaggaggagtctgagggtgccatctggtag

SEQ ID NO: 26155 - RNA, 9873 nt, synthetic construct
  misc_feature 1..9873: note = derived and/or modified CDS sequence (opt11) from DENV-3__KC762687__SS-prME
  source 1..9873: mol_type = other RNA
acctcactgtgcttaatgatgatgttgcctgcaacactggcattccatcttacatctcgagacggggaaccccgaatgatcgtcggtaaaaatgaacgagggaaaagcctattattcaaaaccgcaagcggcatcaatatgtgcacactaatagccatggacctgggggaaatgtgtgacgacacagtgacctacaaatgcccactaatcaccgaagtagaaccagaagatatcgactgctggtgcaacctgactagcacatgggtcacatacggcacgtgtaatcaagcgggtgaacacaggagggataagcgaagcgtagctctggccccacatgttgggatgggcttagacacacgcgcccaaacctggatgagcgcggaaggcgcatggagacaagttgaaaaagtcgagacgtgggcattccggcatccgggtttcacaatactagcattattcctcgcacattatataggaacatcactgacccaaaaagtggtgatatttatattactaatgctggtcaccccttctatgacaatgcgatgtgtgggggtaggcaatagggactttgtcgaaggactcagcggagcaacttgggttgatgtagtgctagagcacggagggtgcgtgaccacaatggccaaaaataaaccaacactcgacatcgagctccagaaaaccgaagcgacgcaactggcgacgctcaggaagttatgcatcgagggcaaaatcacgaacgtgaccaccgacagccgatgcccaacacaaggagaggcgatactccccgaggagcaggatcagaactacgtctgcaagcatacctacgtggaccgaggttgggggaacggttgcggtttgttcggtaagggcagcctcgtgacctgcgccaagttccaatgcttagagttcatcgaggggaaggtagtacagcacgaaaacctaaagtacacagtaataataaccgtacataccggcgaccaacaccaagtggggaacgaaacgcaaggtgtcacagctgaaatcactccacaagcctctacagtggaggcaatactgcccgaatatggaaccctgggccttgagtgcagcccccgcaccggtcttgacttcaacgagatgatcctactaacaatgaaaaataaagcgtggatggtccataggcaatggtttttcgacctacctctaccatggacaagcggcgcaaccacagagactccgacttggaacaagaaagaactcctagttacgtttaagaatgcccacgccaagaaacaagaggtagttgtgttaggaagccaagaaggtgcgatgcatacggccctaacaggcgcgacagagattcaaacaagtggaggcaccagtatcttcgcggggcacctcaaatgccgcttgaagatggacaaactcgagctaaaaggcatgagttacgcaatgtgcctaaacgcattcgtactcaagaaagaagtcagtgagacacagcacggaactatactaatcaaggtcgaatacaagggcgaggacgcaccctgcaaaatacctttctcaaccgaggatggtcagggtaaagctcacaacgggagacttatcaccgcaaaccccgtcgttgtaaagaaggaggagcctgtaaacatcgaagcggaaccgccatttggagaatctaacatcgtaataggaataggggacaaggctctcaaaatcaattggtacaagaagggcagctctatcggaaaaatgttcgaggccaccgccaggggagcacgccggatggccatcctaggggacacggcttgggatttcggatccgtgggcggggtgttaaactctctaggaaagatggtacaccaaatatttggcagtgcatacacggccctctttagcggagttagctggataatgaaaataggtatcggagtattgctgacgtggatcggcctcaatagcaaaaatacatccatgagcttcagttgtatcgtaatagggatcatcaccctatacctgggcgcagtcgttcaggcggatatgggatgtgtgataaactggaaaggcaaagaactcaagtgcgggtcaggaatctttgtgaccaacgaggtacacacctggacggaacagtacaagttccaggccgactcacctaaacgcttagcaacagctatcgcaggagcctgggaaaacggggtgtgcggcatcaggagcaccaccagaatggagaatctgctctggaagcaaattgcaaacgaacttaactacatcctctgggaaaacaacataaagctaactgtagtagtcggagacatcataggagtcctcgaacagggaaagcggaccctaacaccacagccaatggagctgaaatactcctggaaaacgtggggcaaagctaaaatagttacagctgagacccagaactcgtcatttattattgacggacctaacacaccggaatgcccttcagcctctcgggcatggaacgtatgggaggtagaagactacggcttcggggtattcacaacaaacatttggctaaaactacgggagatgtacacacagctctgcgaccaccgcctaatgtcagcggcagtgaaagatgagagggcagtccacgcagacatgggatactggatagaatcccaaaagaacggaagttggaaactcgaaaaagcgtctctgatcgaagtaaagacatgcacatggccaaagtcacacactctctggagcaatggcgtactggaaagcgatatgataataccaaagagcctagcaggacctgtgtcacaacacaactatcggccaggataccacacgcagacggctggcccgtggcacctaggcaagctggagctggacttcaactactgtgaaggcaccacagtggtgattacagaaaactgcggtacgcgcggaccatctctgcggactaccacagtgagtgggaaattaatacacgagtggtgctgccgatcttgtacactgcctcccttgagatacatgggagaggacggatgctggtacgggatggaaatacgcccaatcaacgagaaagaagagaacatggtaaaaagcctcgtttctgccggctcggggaaggtcgacaacttcacaatgggcgttttgtgcctagcgatcctctttgaagaagtcatgagaggcaaattcggcaagaaacacatgatagcgggagtcctattcacgttcgtgttactccttagcgggcagatcacctggcgggacatggcgcgtacactgatcatgataggctcgaacgcaagcgataggatggggatgggtgtaacatacctcgcactcatcgccacgttcaaaatacagccatttctggcactagggttctttctccgcaaactgacatcacgggaaaacctcctcctcggggttggactagccatggccacgaccctccagctgcctgaggatatcgaacaaatggcaaacggcatagcccttggcctcatggccctaaaactgattacgcaattcgaaacatatcaactttggaccgcccttgtctcactgatgtgttcaaacaccatattcaccctcaccgttgcatggcgcacagccacgctcatcctggcaggcattagtttgttccctgtctgccaatcttcgtccatgcggaagacagactggctacccgtaacagtcgcggcgatgggcgtaccgcctctaccattatttatattcagcctgaaggatacgctcaaaaggcggagctggcccctcaacgagggggtcatggcggtgggcctcgtctccatactggcgtcgtccctactcagaaacgacgtcccaatggccggaccgttagtcgcagggggcctactaattgcctgctacgtcataacaggtacaagtgcagacctaacagtcgaaaaagctgcagacgtaatatgggaggaggaggcggagcaaacgggagtttctcacaacctaatgataaccgtcgacgatgatgggacgatgcgcattaaggacgacgagaccgaaaatattctgacagtgctgctcaagacggcactcctgattgtgagtggtatcttcccctattcgattcccgccacattacttgtatggcacacctggcaaaagcaaacccaacgctccggagtactatgggacgtcccatccccgcccgaaacgcagaaagcagagctagaggaaggcgtctacaggatcaaacaacagggcattttcgggaaaacacaagtcggagtgggagtgcagaaagagggggtcttccacacaatgtggcatgtgacacgtggagccgtcttaacacacaacggcaagcgtctcgagccaaactgggcctcagtcaagaaagacctaatcagttacggaggaggatggagactttctgcccagtggcaaaagggcgaagaagttcaagtcatagcggtcgaacctggcaaaaacccaaagaattttcagactatgccggggacttttcagaccactactggggagataggagctattgcgttggatttcaagccaggtacctcaggctcgcccataattaatagagagggaaaagtagtggggctctacgggaatggagttgtaactaaaaatggtgggtacgtatccggaatcgcacaaacgaacgcggaaccagacggaccgacacctgaactggaagaagaaatgttcaagaaacgcaacctgaccatcatggatttgcaccccggttcgggcaagacccgaaaatatctccctgcaatcgtaagagaggcaataaaacgaagactaagaaccctcatacttgcgcccacaagagtggtagcggcggaaatggaagaagcccttaagggactcccaatacggtaccagactactgcaaccaagtccgtccacaccgggaaagagattgtggaccttatgtgtcacgcgacgttcaccatgcgtctattaagcccggtcagggtgccaaactacaatctaataataatggacgaagcacactttacggaccccgcgtccatcgcggctagaggatatatctcaacacgcgtcggcatgggcgaggcagcagccattttcatgacagctacacccccaggcactgcagacgctttccctcaaagcaacgcaccaattcaagacgaggaaagagacatacctgaacggagctggaactcgggaaacgaatggataaccgacttcgcaggtaaaactgtatggttcgttccatccatcaaagcggggaacgacatcgcgaactgcctccggaaaaatggcaagaaagtcatacaattaagcagaaagacattcgacaccgagtaccagaaaactaaacttaatgattgggatttcgtggtaacaacggacataagcgaaatgggggcaaacttcaaggccgacagggtcatagatccaaggagatgcctgaagcccgtcatcctaaccgacggtccagagcgggtcattctcgctggaccgatgccggtaactgtggcgtccgcggcacaaaggcgcggtagagtcgggcggaacccccaaaaggaaaacgatcagtatatttttaccggccagcctctcaacaacgacgaggaccatgcacattggacggaagcaaaaatgttactagataacatcaacactccagaaggaatcattccagcactattcgagcctgagcgggagaaatcggcggcaatcgacggcgaataccgtctaaagggggaaagccgaaagacttttgtggagctcatgcggcgtggggaccttcccgtctggctcgcacacaaagtcgcgagtgaaggaatcaaatacacagaccggaaatggtgcttcgatggagagagaaacaatcaaatcctagaagagaacatggatgtggaaatctggacgaaagaaggagagaaaaagaaactacggccacgatggttggatgcaagaacatactcggaccccttggccctgaaagagttcaaagacttcgcagcgggccgcaaaagcatagccttggacctggtaacggaaataggccgagtaccctcccatctggcacacaagacaaggtccgcgctggataaccttgtcatgctgcacacatctgagcacggtggacgggcctacagacacgccgtagaagaacttcccgagacaatggaaactctacttctgcttgggttaatgatcttgcttaccggtggcgccatgctatttctgataagcggtaaaggtataggaaaaacaagcatcggcctaatatgcgtagtcgccagcagcgggatgctctggatggcagacgtcccactgcaatggatagcgtccgccatcgtcctagaatttttcatgatggtactgttaatcccggagccggaaaaacaacgcacaccccaagacaaccagctcgcttacgtagtaatcgggatactaacgttggcggcaatcgtcgccgcgaacgagatgggattgcttgagacaaccaaacgggatctgggcatgtcaaaggagcctggagttgtaagtcctacatcgtatcttgacgtagacttacaccccgcaagtgcgtggaccctttacgccgttgccaccacagtaataactccaatgctgcgacacacaatagaaaattccactgcgaacgtgtcactggctgcaattgcaaaccaagcggtcgttctaatgggcctggacaaggggtggcccataagcaagatggatctgggagtacccctgttggctttaggatgttactcacaagtaaacccactaacgctcaccgcggctgtactactcctggtaactcactatgcgataataggcccaggactacaagccaaagcgaccagagaggcgcaaaaacgaacggctgcaggcatcatgaagaacccaacagtcgacggaatcatgaccatagacctcgatccggtcatctacgactctaagtttgaaaagcagctcggccaagtcatgttgcttgttctatgcgcagtgcaactcctcctcatgcggacaagttgggccttctgcgaggctttgacactcgcaaccggaccaataacaactctatgggagggatctcccggaaaattctggaatacgaccatcgctgtaagcatggccaacattttcagggggtcctacctggccggggcagggttagcgttctcaataatgaaatccgttgggacaggcaaaagggggaccggttcccaaggcgagacgctaggagagaaatggaaaaagaaacttaaccagctctcgcgcaaggagttcgatttatataagaaatcaggcatcacagaagtcgatagaactgaggcgaaagagggcctcaaaaggggcgagatcacgcaccacgccgtctcccgtggctcggcaaagttgcagtggttcgtagaacgaaacatggtcataccagaaggaagggtgatcgacttgggctgtggccgaggcgggtggtcatactactgtgcaggactgaaaaaggtcacggaagtacgcggatacaccaaaggaggaccaggccacgaggagccggtgccaatgtccacatacggctggaacatcgtcaaactaatgtcggggaaggatgttttctacttgccacccgagaagtgcgacaccctactgtgcgacatcggcgagtcgagtccctccccaacagtcgaggagtcccgtacaatacgcgttctgaaaatggtggaaccgtggctaaagaacaatcaattttgtatcaaagtcctaaacccgtacatgccaactgtaatagagcatttggagaggttacagcgaaaacacggcgggatgcttgtaagaaaccctctaagtcggaactcgacgcatgaaatgtattggatcagcaatggcacagggaacatagtcagcagtgtcaatatggtcagtcgattattactgaaccgatttacgatgacccacagaaggccgacgatcgagaaagacgttgacttgggcgccggaactcggcacgttaacgctgaacccgaaacacccaacatggacgtaatcggggaaaggatccgacgcataaaggaagaacactcgagcacctggcactatgacgaagaaaacccatataaaacgtgggcataccatggatcctacgaagtaaaggcaaccggatcggccagcagtatgataaacggtgttgtgaaactactaacaaagccctgggacgtggtccccacggtaacccagatggccatgacagacaccacaccctttgggcagcaacgggtattcaaagagaaagtagacacaagaaccccacggccaatgccaggtaccaggaaagcaatggaaataacagcggaatggctctggagaaccctggggaggaacaagcgcccacgattatgtacgcgggaagaatttacgaaaaaggtgagaacaaacgcggccatgggcgcggtcttcaccgaggaaaaccaatgggactccgcaaaagcagcggtggaggatgaggagttctggaagctagtggatagagagcgagaactacacaagctgggcaaatgcggctcctgcgtctacaatatgatgggtaaaagggagaagaaactaggggaatttggcaaagccaaaggaagcagggcaatatggtacatgtggctgggggcccgttacctcgagttcgaggcattaggcttcttaaatgaagaccactggttctctcgagagaacagtttctctggagtcgaaggggagggactacacaaactcggctacatattaagagacatctcaaaaataccaggtggagctatgtacgccgatgacacggcaggctgggacacacggatcacagaggacgacctccataacgaggagaaaataacgcagcagatggatcctgaacacagacaactagcaaacgccatcttcaaactcacttaccagaacaaagtcgtaaaggtccagcggcccactccaaagggcacagtgatggacataatcagcagaaaagatcagagggggtcggggcaagtaggaacatatggcctcaacaccttcaccaacatggaggtacagctcatacggcagatggagggagaaggagtgctgagtaaagcagatctggaaaacccacacctactcgagaaggaaattacgcagtggctggaaacgaaaggtgtagagaggctcaagcggatggccatatcgggtgatgactgcgtagtaaagccaatcgacgacagatttgccgacgcactcctcgcacttaacgacatgggcaaagttcgtaaagacatacctcaatggcagcccagcaaagggtggcacgactggcaacaagtcccgttttgctcacaccactttcatgaactgatcatgaaagatggccggaaactggtagttccgtgtcgaccgcaggacgagctcataggacgagcccgaatatcacaaggcgcaggctggagcctgagggaaaccgcatgcctgggcaaagcgtacgcccagatgtgggcgctgatgtactttcaccgtagggacctacgcttagcctccaacgccatctgcagcgcagtaccagtgcactgggttccaacgtcccgcacaacatggagcatacacgcacaccatcaatggatgacaacagaagacatgctaacggtgtggaacagagtttggatagaagacaacccctggatggaagataaaacgcccgtgacaacgtgggaggacgtgccctacctcggcaagcgcgaagatcaatggtgcggctccctaatagggctcgcctcgagggcaacttgggcccaaaatatattaacggccatccaacaagtgagaagtctaatcgggaatgaagaatttctggactatatgccaagcatgaagagatttcgaaaagaagaagaaagcgagggagcaatttggtag

SEQ ID NO: 26156 - RNA, 9873 nt, synthetic construct
  misc_feature 1..9873: note = derived and/or modified CDS sequence (opt11) from DENV-3__KC762688__SS-prME
  source 1..9873: mol_type = other RNA
acctcactgtgcctcatgatgatgctgccagccaccctggcattccacctcaccagccgtgacggcgagcctagaatgattgtaggaaagaacgagcgcggcaagagcctgctgtttaagaccgcatccggcatcaacatgtgcaccctcatagccatggacctgggcgagatgtgcgacgacaccgttacatataagtgccccctgataaccgaggtggagcccgaggacatcgactgctggtgcaacctcacaagcacctgggtgacgtacgggacctgcaatcaggccggcgaacaccgcagagacaaacgatccgtggccttagcgcctcacgtgggcatggggctggacacgcgcgcacagacctggatgagcgccgaaggcgcctggcggcaggtcgaaaaggtggagacgtgggccttccgccaccccgggttcaccatactcgcgctgttcctggcccattacatcggcacatccctcactcagaaggtggtgatcttcatcctacttatgttggttacacccagcatgactatgcgctgtgtaggggtgggcaatcgcgacttcgtcgagggcctgtccggggcgacctgggtggacgtggttctggagcacggcgggtgtgtaaccaccatggccaagaacaagcccacactcgacatcgagctacagaagaccgaggccacacagctggcgactctccggaagctgtgcatcgagggaaaaatcacgaacgtcaccaccgacagccgctgtcccacgcaaggagaggccatacttcccgaggagcaggaccagaactacgtctgcaagcacacctatgtggacagggggtggggcaacgggtgtggcctctttggcaagggatccctggtaacgtgcgcgaagttccagtgcctggagttcatcgaaggtaaggtagtgcaacacgaaaacctcaagtatacggtgatcattacggtccacaccggggatcagcatcaggtaggcaacgagacccagggagttaccgctgagatcacgccccaggccagcacagtggaggcgatcctgcccgagtacggcactctcgggttagagtgcagcccccgcaccggactggatttcaatgagatgatactgttgaccatgaagaacaaggcgtggatggtgcaccggcagtggttcttcgacctgccgttaccatggacgagcggcgccacaaccgagactcctacgtggaataagaaggagctactggtcacctttaagaacgcccacgccaaaaaacaggaggtcgtcgtcttgggatcgcaggagggcgcgatgcacaccgcgctcacaggtgccactgaaatccagaccagcggcggaacctccatcttcgccggccacttaaagtgcaggttaaaaatggacaaactcgagctgaagggcatgagctacgccatgtgtctgaacgctttcgtgctcaagaaggaggtatccgaaacccaacacggaacgatactgatcaaggtcgagtacaagggcgaggatgccccatgcaagatccccttcagcacagaggacgggcagggcaaggcacacaacgggcggctgatcaccgccaaccccgtggtgaccaagaaggaggagccggtcaatatcgaggcggagcccccgttcggtgagtcaaacattgttattggcatcggtgacaaggctttaaagattaactggtacaagaagggttccagcatcgggaagatgttcgaggctacggcgcgcggcgcccggcgcatggctatccttggcgacaccgcctgggacttcgggtccgtgggcggagtcctgaacagcctgggcaaaatggtgcatcagatcttcggctcagcctacacagccctattctcaggcgtgagttggatcatgaagatcggaattggggtcctacttacctggatcggcttgaacagcaaaaacacgtccatgagcttctcctgcatcgtgatcggaatcatcaccctgtaccttggcgccgtggtccaggcggacatggggtgcgtgatcaactggaagggcaaggaactcaagtgcggcagcggcattttcgtgacgaacgaagtacacacgtggacggagcagtacaagttccaggcggactcccccaagcggctggccaccgccatcgccggcgcgtgggagaatggggtctgtgggattcggtcaactaccaggatggagaacctgttgtggaagcagatcgccaatgaactgaactacatcctgtgggagaacaacattaagctcacggttgtcgtgggggacatcatcggagtgctggagcagggcaagcggaccctgacgccccagcccatggagctcaagtactcctggaagacctgggggaaggccaaaatcgtcactgcggagacgcagaacagctccttcatcatcgacggacctaacacccccgagtgtccctccgcgagccgggcatggaacgtgtgggaagtagaggactacgggttcggagtattcaccacgaatatctggctgaagcttcgtgagatgtacacccagctctgcgaccacagactgatgtctgctgcagtgaaggacgagcgggccgtgcacgcagacatgggctactggattgagagccagaagaacgggtcctggaagctggaaaaggcctcgctcatcgaagtcaagacttgcacctggcccaagtcccataccctgtggtcgaacggtgtactggagtccgacatgatcattcccaagtcccttgccggtcccgtgtcccagcataattaccgccccggctaccacacgcagaccgccgggccgtggcacctgggaaagttagagctcgacttcaattactgcgagggcaccaccgtcgttatcacggaaaactgcgggacacgcggccccagcctccgcaccaccacggtgtcggggaagttaatccacgagtggtgctgccggagctgcaccttacctcctctccgctacatgggtgaagacgggtgctggtatggcatggagatccggccgataaatgagaaggaggaaaacatggtcaagagcttggtgagcgcaggttcggggaaagtggacaacttcaccatgggcgtcctctgccttgctatcctgttcgaggaggtcatgcgcgggaagttcggtaagaaacacatgatcgccggggtcctgttcaccttcgtcctgctgctctctggtcagatcacgtggcgggatatggctcgtactctgattatgataggctccaacgctagcgaccggatgggaatgggcgtgacctacttagccctcatcgccacctttaagatccagccctttctggcgctggggttcttcctccgcaagctgacatcccgggagaacctgctcctgggcgtcggcctggccatggctaccaccctccagctgcccgaggacatcgagcagatggcgaacgggatcgcactgggattgatggccctgaaacttatcacgcagttcgagacctatcagctctggaccgccctggtcagcctcatgtgctctaacaccctctttaccctgacggtggcctggcgcacagctaccctgatcctcgccgggatctccctgctgcccgtttgtcagagctcctcaatgaggaaaaccgactggctcccggtaacggtggccgcgatgggcgtgccgcccctgcccctgttcatcttttccctcaaggataccctgaagcgccgcagctggccgctgaacgaaggtgtgatggcggtgggcttggtttccatcctggcgagctccctgctccggaacgatgtgcccatggccggccccctggtggctggcggcctgctcatcgcttgctacgtcatcaccgggactagcgctgacctgacggtggagaaggcggccgacgtcatctgggaggaggaggccgagcagaccggcgtctcccacaacctgatgataactgtggatgacgacggtacgatgcgtattaaagatgacgagacagagaacatcctcaccgtgcttctgaagactgcactccttattgtcagcggcatcttcccctattcaatcccggccacgctgctcgtgtggcacacctggcagaagcagacacaacggagtggtgtgctgtgggatgtccctagcccccccgagacccagaaagcagaactggaagagggcgtgtaccgcatcaagcaacaggggatcttcgggaagacccaagtgggcgtcggggtgcaaaaggagggcgtttttcacaccatgtggcacgtcacgcggggcgccgtactcacccacaacgggaagcgcctcgagccgaactgggccagcgtgaagaaggacctgatctcctacggcggtggctggcggctgagcgcccaatggcagaagggggaggaagtccaagtgatagcggtggagccggggaaaaaccccaagaacttccagaccatgcccggcatcttccagacaacgaccggggagatcggagccattgcgctagacttcaagccggggacgtccggcagccccataatcaacagggaaggcaaagtcgtgggactgtacggcaacggggtggtcacgaagaacggcggctacgtgtcaggcattgcacagacaaacgccgagcccgacggaccaacccctgagctagaggaggaaatgttcaagaagcggaacttaaccatcatggacctccaccccggctccggcaagacccgtaagtacctgcccgcgatcgtccgggaggccatcaagcgcagactgcgtactctgatcctggcccccaccagggtggtggccgccgagatggaagaggcgctcaaggggctgcccatccgctaccagacaaccgccaccaagagtgctcacaccggcaaggagatcgtggatctgatgtgccatgccacctttaccatgcggctgctgtcccccgtccgcgttccaaattacaatctgataatcatggacgaagcccacttcacggacccagcgagcattgccgcgcgtgggtacatctccacccgagtgggcatgggcgaagcagctgcaatcttcatgacagccacgcctcccggtacagccgacgcctttccccaaagcaacgctccgatccaagacgaggagcgagacattcccgagagatcctggaacagcgggaacgagtggatcaccgacttcgccggtaagaccgtatggttcgtgccctccatcaaagcaggcaacgacatcgccaattgcctccgcaagaacggcaagaaagtcattcagcttagccggaagaccttcgacacggagtaccaaaagaccaagctcaacgactgggacttcgtcgtgaccacagacatctccgagatgggcgccaacttcaaggcggaccgcgtcatcgacccccggagatgcctaaagccggtcatcctaacggacggccccgagcgggttattctggccgggcccatgcccgttaccgttgcgagcgcagcccaacgccgcgggcgcgtgggtcggaacccgcagaaagagaacgaccagtatatattcaccggccagcctctcaataacgatgaagatcacgcgcactggaccgaggcaaagatgctgttagacaacatcaacacgccggaaggaataatccccgccctctttgaacccgagcgcgagaaatccgccgcgatagacggcgagtacagactgaagggggagagtcgtaagaccttcgtcgagctgatgcggcgcggggacctccccgtgtggctggcccacaaggtcgcctccgagggcatcaaatataccgaccggaagtggtgcttcgacggcgagagaaacaaccagatcctggaggaaaatatggacgtcgagatatggacaaaggagggtgagaagaagaagctccggccccgctggctggacgcccggacctacagcgaccccctggcactgaaggagtttaaggacttcgcggctggacgcaaatccatcgccctggacctggtgactgagatcgggcgcgtcccgagccacctcgctcaccggacccgcaacgcccttgacaacctggtaatgctccacacgagcgaacacggcgggcgggcgtacagacacgccgtcgaagaattccccgagaccatggagacactgctactcctcggtctgatgatcctcttaaccgggggagctatgctgttcctcataagcggaaaggggattggcaagaccagcatcggactgatctgcgttgtggcctccagcggcatgctgtggatggccgacgtgcctctccagtggatagcgtccgccatcgtcctggagttcttcatgatggtcctcttaattccggagcccgagaagcagcgaacgccccaagacaaccaactggcctacgtggtgatcgggatcttgacgttggctgccatcgtcgcggcaaatgaaatgggcctactggagaccaccaagagagacctcggaatgagcaaggagcccggggtggtctccccgaccagctatctggatgtcgaccttcaccccgcgtccgcctggaccctctacgcggttgccaccaccgtgattacccccatgctgcggcatacgatcgagaacagcactgccaatgtctccttggccgccatcgcgaatcaggccgtggttttgatgggcttggacaaggggtggccaatcagcaagatggacctgggagtcccgctgctggccctcgggtgctactcccaggttaaccccctcaccctgaccgccgccgtgctgctcctggtgacgcattatgcgatcatcggccctggcctgcaggcaaaggcaacccgcgaggcacagaagcggaccgccgcggggataatgaagaaccccaccgtggatggcataatgacgatcgacttggacccggtgatctatgacagtaagttcgagaagcagctggggcaggtcatgctgttagttttgtgcgctgttcagctcctcctgatgcgaacatcttgggctttctgcgaagcactaaccctcgctaccggccccatcacaacgctgtgggagggcagcccaggaaagttctggaacacgaccatagctgtttcgatggctaacatcttccgcggctcttacctggcgggggccggcctcgcgttcagcataatgaagtccgtggggacgggtaagcgtggcacaggctcccagggcgagacgctgggggagaagtggaagaaaaagctaaaccagctcagccgcaaggaattcgacttgtacaagaagtccggaatcaccgaggtggacagaaccgaggctaaggaagggctgaagaagggcgagatcactcaccacgcggtctcacggggcagtgccaagcttcagtggttcgtggagcgcaacatggtgatccccgaggggcgagtcattgacttgggctgcgggcgcggaggctggtcctactactgcgccggcctgaagaaagtgacagaggtgcggggctacaccaagggcggcccggggcacgaggaaccagttcccatgtcgacgtacggctggaacatcgtgaagctcatgtccgggaaggacgtattctacttaccccctgagaagtgcgacacgttactgtgcgacatcggagagagctcgcccagccccaccgtagaggaatcccgcacaatccgggtgctcaagatggtggagccctggctgaagaacaaccagttctgtatcaaggtcctgaacccgtacatgcccaccgtgatcgagcacctggagcgtctgcaaagaaaacacggcggcatgctggttcggaaccccctgagccgcaactccacgcatgagatgtactggatctcaaatggcaccgggaacatcgtctccagcgtcaacatggtatcaagactgctgcttaaccgcttcaccatgacccaccggcgcccaaccatcgaaaaggacgtcgacctgggtgccggcactcggcacgtcaacgcagagcccgagacccccaacatggacgtcatcggcgagcgcattcggcgcatcaaggaggagcacagctccacctggcactatgatgaggagaatccatacaagacgtgggcctaccacgggtcttacgaggtcaaggccaccgggtccgccagctcgatgatcaacggagttgtgaagctgctcacgaagccgtgggacgtggtccctaccgtgacgcaaatggccatgaccgataccacccccttcgggcagcaacgggtgtttaaagagaaggtggacacgcgcactccgcggccgatgcccggaacccgcaaggccatggagataacggccgaatggctctggcggaccctgggccgcaataaacggccccgcctttgcacacgcgaggagttcaccaagaaggtaagaaccaacgccgcgatgggggccgtgttcacggaagagaaccaatgggactccgcccgcgctgccgtcgaggacgaggagttctggaaactggtagaccgggaacgcgagctgcataaactcgggaagtgcgggtcctgcgtctacaacatgatgggcaagcgggaaaagaagctgggggagttcggcaaggcgaaaggctcccgagccatctggtacatgtggctgggggctaggtatctcgaattcgaggcacttggcttcctaaacgaggaccactggttcagccgcgaaaactcgtttagcggggtggagggcgagggactccataagctgggctacatcctacgggacatctctaagatcccgggcggtgctatgtacgcggacgacaccgccggctgggacacccgcataaccgaggacgacctacacaacgaggagaaaatcacccagcagatggacccggagcaccggcagctggcgaatgccatcttcaagttaacctaccagaataaggtcgtgaaggtgcagagacctaccccgaaagggacggtcatggacatcatttcccgtaaagatcagcgcggctccggccaggtggggacgtacggcctcaatacctttacaaacatggaggtgcagcttatccggcagatggaaggggagggcgtcctaagcaaggccgacctcgagaacccacacctcctggagaaggaaataacccagtggttagagaccaagggcgtggagcgcttgaagcggatggcgatctccggagacgactgcgtggtcaagccgatcgacgaccgcttcgccgatgccctacttgcactgaacgacatgggaaaggtgcggaaggacatcccccagtggcagcccagcaaggggtggcacgactggcagcaggtccccttctgctcccaccactttcacgagctcatcatgaaggacggccgcaagctcgtcgtgccttgcaggccccaagatgagctgattggtcgcgcccgaattagccaaggcgcggggtggtccttaaaggagacagcctgcctcggcaaggcctacgcccagatgtgggcactaatgtactttcacaggcgcgacttgagattagcatcaaacgctatctgctcggccgttccggtacattgggtgcccaccagccgaaccacctggtccatccatgcccaccaccagtggatgacgaccgaggatatgctgaccgtgtggaaccgggtttggatagaagacaacccgtggatcgaggacaagacccccgtgactacctgggaggatgtgccctatcttggcaagcgtgaggatcagtggtgcgggagcctcatcggactggccagtagagccacctgggcccagaatatcctcaccgccatacagcaggtgagatccctcatcgggaacgaagaatttctggactatatgccgagcatgaaacggttcaggaaggaggaagagtcggaaggggccatctggtag

SEQ ID NO: 26157 - RNA, 9873 nt, synthetic construct
  misc_feature 1..9873: note = derived and/or modified CDS sequence (opt11) from DENV-3__KC762689__SS-prME
  source 1..9873: mol_type = other RNA
accagcctgtgcctcatgatgatgattcccgccaccctggcctttcacctgacctccagagacggcgagccccggatgatcgtggggaagaatgagcgcgggaagagtctcctgttcaagaccgctagcgggatcaatatgtgcacactgatcgccatggacctcggcgagatgtgcgatgataccgtgacctacaagtgccccctgattaccgaggtggagcccgaagacatcgactgttggtgcaacttaacgagtacctgggtcacctacgggacctgcaaccaggccggcgagcatcgacgggacaagcggtccgtggccctcgcgcctcacgtgggcatgggactggacacacgcgcgcagacctggatgagcgccgagggcgcttggcggcaggtcgagaaagtagagacgtgggccttccgccaccccgggttcaccatacttgccctttttctggcccattacatcggcacctccctcacccagaaagtggtgatcttcatcttactgatgctggtcacgcccagtatgaccatgcggtgcgtgggggtgggcaacagggatttcgtcgagggcctctccggggcgacctgggtagatgtagtcctggaacacggcgggtgcgtgaccacgatggccaagaacaagcccacgctggatatcgagctccagaagactgaggccacccagctggccacgttgcggaagctctgcatcgagggcaagatcactaacgtgaccaccgactcaagatgccccacgcagggcgaagcgatcctgccagaggagcaggaccagaactacgtctgcaaacacacctatgtggaccgggggtgggggaacggatgcggcctgttcggaaagggctccttggtgacctgcgccaagttccagtgcctcgagttcatcgagggcaaggtcgtgcagcacgagaatttgaagtacaccgtgataatcacggtccacaccggtgaccagcaccaggtgggcaacgagacccaaggtgtcaccgccgaaataacgccccaggccagcacggtggaggcgatcctccccgagtacggcaccctgggattagagtgctccccgcgcacaggcctcgattttaacgagatgatcttgctcaccatgaagaacaaggcttggatggtgcaccgacagtggttcttcgacctcccgcttccctggacgtctggcgccaccactgagacacccacgtggaacaagaaagagctgctagttacgttcaaaaacgcccacgccaaaaagcaggaggtagtcgtcctggggtcccaagagggcgctatgcacaccgccctgaccggggcaacggagatccaaactagcggcgggaccagcatattcgccggtcacttaaagtgccgcttaaagatggacaaactagagctcaagggcatgagctacgccatgtgcctgaacgctttcgtgttgaagaaggaagtgtccgagacccagcacggaacgatcctcatcaaggtggagtataagggagaagacgcgccgtgcaagatcccgttcagcactgaagacgggcagggaaaggctcacaacgggaggcttataaccgctaacccggtggtgacaaagaaggaggagcccgtcaatatcgaggcggagcccccgttcggcgagagcaacatcgtaatcggcataggagataaagcgttaaagataaactggtacaagaaaggatcctccataggcaagatgttcgaggccacagccaggggcgcacgccgcatggcgatcctgggggacaccgcctgggatttcggttctgtgggcggggtcctcaacagcctgggcaagatggtacaccagatattcgggtccgcatacaccgccctcttcagcggcgtatcctggatcatgaagatcggcatcggggtcttactcacctggattggactaaacagcaaaaatacgtccatgagcttctcctgcatcgtaatagggatcatcaccctctatttgggcgcagtggttcaggccgacatggggtgcgtgatcaactggaagggcaaggagctgaaatgcggcagcgggattttcgttaccaacgaggtccacacatggacggaacaatacaagttccaggccgactcccccaagcgattggccaccgccatcgccggcgcgtgggagaatggcgtgtgtggcatccgctctaccactcgcatggaaaatctgctctggaagcagatcgccaacgagctcaactacatactgtgggagaataacatcaagctgacggtcgtcgtgggtgacatcatcggcgttctcgagcagggcaagcgaaccctgacgccccaacctatggaactaaagtactcttggaagacctgggggaaagcaaagatcgtcacggccgagactcagaacagttcgttcatcatcgacggcccaaacacccccgagtgccccagcgcgtcccgcgcctggaacgtgtgggaggtggaggactacgggttcggagtgtttactacgaacatatggctcaaactgcgggaaatgtacacacaactgtgcgaccatcgcctcatgagcgctgcagttaaggacgagcgggccgtgcacgcggatatggggtactggatcgagtcccagaaaaacggatcctggaagctggagaaggccagcctgattgaggtaaagacctgcacctggccaaaatcccataccttgtggagcaacggggttctcgaatccgacatgataatccccaaaagcctggctgggcccgtgtcccaacacaactaccgccccggctaccacacccagactgccgggccgtggcaccttggcaagctggagcttgacttcaactactgcgagggcaccaccgtcgtgatcacagaaagctgcgggacgcggggcccctccctccgcacaacaacggtaagcggtaagctgatccacgagtggtgttgccgctcctgcacccttccgcccctgcgctacatgggcgaggacggatgctggtacggcatggagatccggccgatcaacgagaaggaggagaacatggtcaagagcctggtgtccgccggctcgggcaaggtggacaacttcacgatgggagtcctgtgcctcgcgattctgttcgaggaggttatgcgcgggaagtttggcaagaagcacatgatcgccggggtgctgtttaccttcgtgctcctgctttccggccagatcacgtggcgggatatggcccgcaccctcatcatgatcggctcgaatgcctccgaccggatggggatgggagtgacctacttagccttaatcgcgacctttaagatccagcccttccttgctctcgggttcttcctgcgcaagctcacgagccgggaaaacctgctcctcggagtgggcctggccatggccacaactctgcagctcccggaggacattgagcaaatggcaaatgggatagccctgggactgatggccctcaagctgatcacccagttcgaaacgtaccagctatggaccgccttggtgagcctgatgtgctccaacaccatctttactctgactgtagcctggcgcaccgcgacactcatcctggctgggatatctctgctccccgtctgccagtcctcttcgatgcggaagaccgactggctgccggtgacggttgccgccatgggcgtgccgcccctgcccctcttcatcttcagcctgaaagacaccttaaagcggcgctcctggccgttaaatgagggggttatggccgtcggcctggtaagcatactggcatcgagcctactgagaaacgacgtccctatggcgggccccctcgtggcgggtggcttactgattgcctgctacgtcatcaccgggacctccgccgacctcacagtggagaaggcagccgatgtcatctgggaggaggaggcagagcagaccggggtcagccataaccttatgatcaccgtggacgacgacgggaccatgcgcatcaaagacgacgagacggagaacatcctgaccgttctgctcaagaccgccctgctgatcgtctccggcatcttcccctacagcatcccggccaccctcctagtgtggcacacatggcaaaaacaaacgcagcgttccggggttttatgggacgtccccagcccgcccgaaacccaaaaggcagagctcgaggagggggtataccgcatcaagcagcagggcatcttcgggaagactcaggtaggcgtcggtgttcagaaggagggcgtgttccacactatgtggcacgtcactaggggcgcggtgctgacccacaacgggaagcgcctggagccgaattgggcctccgtaaaaaaggacctcatctcgtacggcgggggctggcggcttagtgcccagtggcagaagggcgaagaagttcaggtggtggcagttgagccgggaaagaaccccaagaattttcagaccatgcccggaatattccagaccacgaccggggagatcggcgccattgccttagacttcaaaccgggcaccagcggcagccccataatcaaccgcgagggcaaggtggttgggctgtacggcaacggggtagtgaccaagaacggtgggtacgtgagcggcatcgcgcagacgaacgccgagcccgacggccctacccccgacctggaggaggagatgttcaagaagcggaacctgaccataatggatctacatccagggtccggaaaaacacgcaagtacttgcccgcgatagtccgcgaagccataaagcgtcgcctgcgcacgctgatcctggccccgacccgggtggtggcagccgagatggaagaggcgctaaagggcctgcctatccgataccagaccaccgccacgaagtccgtccacactggcaaagaaatcgttgacctcatgtgccatgccaccttcactatgcggctgctgagccccgttcgcgtccctaactacaatctcatcattatggacgaggctcatttcacggacccggcatccattgcggcccgggggtatatcagcacccgggtagggatgggcgaggcggctgcgatatttatgaccgccacgccgcccgggacggccgatgccttcccacagagcaacgccccgatccaggacgaggagcgggacattcccgagcgcagctggaactccggcaacgagtggatcaccgacttcgcggggaagaccgtgtggttcgtccccagcatcaaagcagggaacgacattgccaattgcctgcgcaagaatgggaaaaaggtgatccagctgagccggaagaccttcgacacggagtatcagaagaccaagctaaacgactgggacttcgtggtcaccaccgacatcagcgagatgggcgccaacttcaaggccgatcgggtgatcgaccccaggcgctgcttaaagccggtgatcttaacggacggccctgagcgggtgatcctcgcagggccaatgccagtgactgtcgcgtctgccgctcagcgcaggggccgcgtggggcggaatccgcagaaggagaacgaccagtacatatttaccggtcaacccttgaacaatgacgaggatcatgcgcactggaccgaggctaagatgctgctcgacaatatcaacacgcccgaggggatcatccccgctctgttcgagccagagcgcgagaagtccgccgcgatcgacggagaataccgactgaagggagagtcccgcaagacctttgtggagttgatgcggcgcggggaccttcccgtgtggctggcgcacaaggtggcatcggaaggcataaagtataccgaccggaagtggtgcttcgacggggagcgcaacaatcagatcctcgaggaaaacatggacgtagaaatctggacgaaggagggagagaagaaaaagctgagacccagatggctggacgcgcggacctacagtgacccattggcactgaaagagttcaaggactttgccgcagggcgaaagagtatcgcactggacctcgtcactgaaatcgggcgcgtgccgtcccacctggcctaccgaactaggaacgccctggacaatcttgtgatgctgcataccagcgagcacggcggtagagcctaccgccacgcggtcgaggagctgcccgagaccatggagacgctcctgctgctcggcctgatgatattactcactgggggcgccatgctgtttctgattagcggcaaggggatcgggaagacctctatcgggctcatctgcgtggtggcctcctctggtatgttgtggatggccgacgttcccctgcagtggatcgcctctgcgatcgtactagagttcttcatgatggtgctgctgatcccggagcccgaaaagcagaggaccccccaagataaccaacttgcatacgttgtaatcggcatcttaacgttggccgccatcgtggccgccaacgagatgggcctcctggaaaccaccaagagagacttaggcatgtccaaggagccgggggtcgtgagcccgacctcctacctcgatgtagatctgcaccccgcctctgcgtggacgctatatgcggtggcgacaaccgtgatcaccccgatgctccgccacaccatcgagaattcgaccgcgaacgttagccttgccgccattgccaaccaggcggtcgtgctgatgggccttgacaaagggtggcccatctccaaagtagatctgggcgtccctttactggctctgggctgctatagccaggttaatccgctgacactcaccgccgcagtgctgctgttggtcacacactatgccatcataggccccgggctccaagcgaaggccacgcgcgaggcccagaagcggaccgctgcggggataatgaagaacccaaccgtggacggaatcatgacgatcgatctggacccggtgatctacgactcaaagttcgaaaagcagctgggtcaagtcatgttgctggtgctatgtgctgttcagctgctgctcatgcgcaccagttgggccttctgcgaggccctgaccctggccacgggccccataacaacactctgggagggctcaccggggaagttctggaacacaacgatcgcagtcagcatggccaacatcttccgaggatcgtacttggctggcgcaggcctagcgttctccatcatgaagtccgtggggacgggtaagcgcggcacaggaagccagggcgagaccctcggggagaaatggaagaaaaagctgaaccagctgagcaggaaggaattcgatctgtataagaaaagtggcatcacagaggtggaccgcacagaggcgaaggaggggctcaagcgcggcgagaccacacaccacgccgtctcacgcggctctgccaagctacagtggtttgtagagcggaacatggtgatacccgaggggagagtcatagacttgggctgcgggcgaggggggtggagctactactgtgccggcctgaagaaggtgaccgaggttcgcggctacaccaagggagggccggggcacgaggagcccgtccccatgagtacgtacggatggaatatcgttaagctgatgtcagggaaggacgtgttctacctccccccagaaaagtgcgacacactgctgtgcgacataggcgagtcctcaccctccccgaccgtcgaggagtctcggaccatacgcgtgttaaagatggtggagccctggctcaagaacaaccagttctgcatcaaagtcctgaacccctacatgcccacagtgatagagcacctggagcgcctccagcggaagcatggcgggatgctagtccgcaaccccctgagtcggaatagcacccacgagatgtactggatctccaacgggacagggaacatcgtcagcagcgtgaatatggtcagccgcctattactgaaccggttcacgatgacgcaccgccggcccaccatcgagaaggacgtggacctcggggccggcaccagacacgtgaacgcggagccggagactcccaacatggacgtgattggggagcggatccgccgcattaaggaggagcactccagcacttggcactacgatgaggagaacccctataagacttgggcctaccacggctcatacgaggtgaaggcgaccgggagcgccagcagcatgatcaacggcgtggtcaaactgctgaccaaaccgtgggacgtagtgccgacagtgacccagatggccatgacagacaccacgcccttcggccaacaacgcgttttcaaggaaaaggtggatacccggacgcctcgcccgatgccgggcacccgcaaggcgatggagatcaccgcagagtggctctggcgcaccctgggccggaacaagcgcccccggctatgcacacgcgaggagttcaccaaaaaggtgcgcacgaacgccgccatgggggcggtgttcactgaggagaaccagtgggactcagcccgggccgccgtcgaggacgaggagttctggaagctcgtcgaccgggagagagagctgcacaagttaggtaagtgcgggtcctgtgtgtacaatatgatggggaagcgcgagaagaagctcggggaatttggtaaggccaagggcagccgggcgatatggtatatgtggctgggggcccgctacctggagttcgaggccctcggcttcctgaacgaggaccattggttcagtcgcgagaactcattctcaggcgtggaaggggaggggctgcacaagttaggatacatcctgcgggacataagcaagatccccggcggggccatgtacgcagacgacaccgcgggctgggacacccggatcacggaggacgatctgcataacgaggagaagatcacccagcagatggatccggagcatcgccagctggccaacgccattttcaagctgacctatcagaacaaggtcgtgaaagtacagcggcctacccccaaggggacggtcatggacatcattagtcgaaaggaccagcggggaagcggtcaggtggggacttacggcttaaacactttcaccaatatggaggtgcaactaatccgccagatggagggcgagggcgtcctgagcaaggccgacctggagaacccccacctcctggagaaggaaataacacaatggctggaaacgaagggggtcgaaagattgaagcgcatggccatctccggcgacgattgcgtggtcaagccgatcgatgaccggttcgcggacgcactgctggccctcaacgacatgggcaaggtgcgtaaggacatcccccagtggcaaccatccaaggggtggcacgactggcagcaggtccctttctgtagccaccacttccacgaactgatcatgaaggacggccgaaagctggtagtaccgtgcaggccccaggatgagcttatcgggagagcccgcatctcccagggggccgggtggagcctgaaggagaccgcgtgcctgggcaaggcatacgcccagatgtgggccctcatgtacttccaccgccgggatctgcgtctggcgtccaatgccatctgtagcgctgtgcccgtccactgggtgccgaccagccggacaacatggagcatccatgctcaccatcagtggatgacgactgaggacatgctcaccgtatggaaccgagtctggatagaagacaatccgtggatggaagacaagacgcccgttacaacctgggaggacgtgccctacttgggcaagcgggaggaccaatggtgcggatcgctgattggtctcgcctccagagcgacgtgggctcagaacatcctgacggctatccaacaggtccgtagcctgatcgggaacgaagagttcctcgactacatgcccagtatgaagcgcttccggaaagaggaggagagcgaaggcgccatctggtga

SEQ ID NO: 26158 - RNA, 9873 nt, synthetic construct
  misc_feature 1..9873: note = derived and/or modified CDS sequence (opt11) from DENV-3__KC762690__SS-prME
  source 1..9873: mol_type = other RNA
acctcgctgtgcctcatgatgatgctgcccgccaccctggcattccatcttacaagtcgcgacggcgagccccggatgatcgtggggaagaacgagcgcgggaaaagcctcttgttcaagaccgcctccggaatcaatatgtgtaccctcattgcgatggacctgggcgagatgtgcgatgacaccgtaacctataagtgccccctaatcaccgaggtggagcccgaggacattgactgctggtgcaatctcaccagcacctgggtaacctatgggacctgcaaccaggctggcgaacaccggcgcgacaagcggtccgtggccctggcgccccacgtgggtatggggctggacacgcgcgcgcaaacctggatgagcgccgaaggcgcttggcggcaggtcgagaaggttgaaacctgggcctttcggcatcccgggttcaccatcctcgcattgttcctggcacactacatcgggacctccctcacccagaaggttgtgatcttcatcttgttaatgctcgtcacgcccagcatgaccatgcgatgcgtaggggtgggtaatcgggattttgtcgagggcctgtccggcgccacctgggtggatgtggtgctggagcatggcggctgcgtgaccaccatggctaagaacaaacccactctcgacattgagctgcagaagaccgaggctacccagttggctactctacgtaaactttgcatcgagggcaagatcaccaacgttaccactgacagccggtgcccgacccagggcgaggccatattgcctgaggagcaggatcagaattacgtgtgcaagcacacttacgttgaccgggggtggggaaatgggtgtggcctctttgggaagggctcgctggtcacatgtgccaagtttcagtgcctagagttcatcgagggcaaggtcgttcagcacgagaacttgaagtatacggtgatcatcacggtccacaccggtgatcagcaccaggtcggcaacgagactcaaggggtaactgcggagataacgcctcaggccagcaccgtggaggcgatcttgcccgagtacggcaccctgggtctcgaatgctcgccccgcaccggcctggatttcaacgaaatgatcctgctcaccatgaagaacaaggcctggatggttcacaggcagtggttcttcgaccttcctctgccctggacgagtggcgccaccaccgagaccccgacctggaacaagaaggagctcctggtgaccttcaagaacgctcacgccaaaaagcaggaggtcgtggtgctggggtcccaggaaggcgcgatgcacaccgcgctgaccggggccacggagattcaaacgagcggcgggacctccatcttcgcaggccacctgaagtgccgcctgaagatggacaagctagagctgaaggggatgagctatgccatgtgtctgaacgcgttcgtgctcaagaaggaggtgtccgagacgcagcacggaacgatcctgatcaaggtggagtataagggcgaggatgccccatgcaagatcccgttcagcacggaggatgggcagggcaaggcccacaatggccgcctgatcaccgcgaaccccgtggtgacaaagaaggaggagcccgtcaacatcgaggcggaacccccgttcggggagagcaacatcgttatcggcatcggggacaaggcgctaaaaatcaattggtacaagaagggctcaagcatcgggaaaatgttcgaggccacagccaggggcgccaggcgcatggcgatcctcggcgacaccgcctgggactttgggtccgtgggcggcgtcctgaactccctgggcaagatggtgcaccagatattcgggagcgcctacaccgccctctttagcggcgtctcttggatcatgaaaatcggtatcggggtcctgctgacctggatcggcctcaactctaagaacacgtcaatgagcttctcctgcattgtgataggtatcatcaccctgtacttaggcgccgttgtccaagcggacatgggatgtgtgatcaattggaaaggcaaggaacttaagtgcggcagtgggattttcgttaccaacgaagtccacacttggaccgaacaatacaagttccaggccgactcccccaagcgcttagccaccgccatcgctggcgcgtgggagaacggtgtgtgcggtatccgcagcaccacccgcatggaaaacctcctctggaagcagatcgctaatgagcttaactacatcctgtgggaaaacaacatcaagttgacggtggtcgtgggggacatcatcggcgtgttagagcaaggcaagcggaccctgacaccccaacccatggagctcaagtactcatggaaaacgtgggggaaggccaagatcgttacggccgagacccagaacagctccttcataatcgatggcccgaacactcccgagtgtccttcggcgtcccgagcctggaacgtgtgggaggtggaggactatgggttcggcgtcttcactacgaacatctggctgaaactgagggagatgtacacccagctctgtgaccaccgcttaatgagcgccgcagtgaaggacgagcgggccgtgcacgcagatatgggctattggatcgagtcacagaagaacgggtcgtggaagctagaaaaggcgagcctaatcgaggtcaagacctgcacctggcccaaatcccacacactgtggagtaacggcgtgcttgagtccgacatgatcatccccaagtcccttgccgggcccgtgtcccagcacaactatcgccccggctaccatacgcagaccgccggaccttggcacctgggcaaattggagctcgacttcaactactgtgagggcacgaccgtcgtgatcacggagaactgcggaacccgtgggccgagcctgcgcaccaccacggtgtccgggaaacttatccacgagtggtgttgccgcagttgcacactgccgcccctccggtacatgggcgaggacgggtgctggtacggcatggagatccggccgatcaatgaaaaagaggagaatatggtcaagtccctagtgagcgccggctccgggaaggtggacaacttcactatgggcgtcctctgcctcgcgatcctgttcgaggaggtgatgagagggaagttcggcaagaagcacatgatcgccggcgtcctgttcacatttgtcctgctgctctcaggccaaattacatggcgggacatggcccgtacactgattatgatcggctccaatgccagcgaccggatggggatgggtgtaacctacctggccttgattgcaaccttcaagatacagcctttcctggccctgggattctttttacggaagttgacgtccagggagaacctgctcctcggagtgggcctggctatggctacgaccctccagttacccgaggacatcgagcagatggctaacgggattgccctcggcctcatggccttaaagctgattacccagttcgagacttaccaactctggacggccctggtctcactgatgtgtagcaataccatcttcaccctcacggttgcctggcgcaccgcgaccctgatcctggctggcatttccctgctgcccgtctgccagagctcctcaatgcggaagaccgactggctgccggtgacggtcgccgccatgggcgtgccgcccctccccctattcatcttctcccttaaggacacgttaaagaggcgcagctggccgctgaacgagggagtgatggcagtgggcctcgtatccatactcgcgtcctcactgctgcgaaacgacgtgcccatggccggccccctcgtggccgggggtctcttgatcgcctgctacgtcattaccgggactagcgccgacctcaccgtggagaaggcggcggatgttatctgggaggaggaagccgagcagaccggcgtctcccacaaccttatgattaccgtggacgacgacgggaccatgcgcatcaaggacgacgagacagagaacatcctgacggtgcttcttaaaacagccctgctcatcgtaagcggcatatttccctactccatccctgcaactctgctggtgtggcacacctggcagaagcagacgcagcggagtggcgtgctctgggacgtgcccagtccgcccgagacccagaaggcggagcttgaggagggggtgtaccgaatcaaacagcagggcattttcgggaagacacaggtgggcgttggggtacagaaggaaggagtgtttcacaccatgtggcacgttacccggggcgcagtcttaacccacaacgggaaacgcctagagccgaactgggcctcagtaaagaaagaccttatttcctacggcgggggctggcggctgagcgcccagtggcagaaaggggaggaggtccaggtcatcgcggtggaacccggcaagaaccccaagaattttcagaccatgccagggatattccaaacaacgaccggggagatcggcgccattgccctggatttcaaaccagggacgtccggcagccccataatcaaccgcgagggcaaggtcgttgggctctatggtaacggggttgtaacgaagaacggcgggtacgtaagcgggatcgcccagacgaacgctgagcccgacggcccgacccccgagcttgaggaggaaatgttcaagaagcggaacctgactatcatggacctgcaccccggatctggcaagacccggaaatatctgcccgccatcgtccgggaggccataaagcgtcggctccgcaccctgatcctggcgccgacacgtgtggtggccgccgagatggaagaggcgttaaaggggctaccgattcgctatcagaccaccgccaccaaaagcgcccacaccgggaaggagatcgtggacctgatgtgccacgccaccttcaccatgcggctgctctcccccgtccgggtacccaactacaacctgatcattatggatgaggctcatttcacggatcctgcgagcatcgctgcccgggggtatatctccacccgcgtgggcatgggcgaagccgcggccattttcatgaccgccactccacccgggacggccgacgctttcccgcaatctaacgcgccaatacaggacgaggaacgggacatccccgagcgatcctggaatagcggcaacgagtggatcaccgacttcgctgggaagaccgtctggttcgtaccctccataaaggccggcaatgatatcgccaactgcctgcgcaagaacgggaagaaagtgatacaacttagccggaagacctttgacactgagtatcagaagaccaagctgaatgactgggacttcgtcgtgacgactgacatctctgagatgggcgccaacttcaaggcggaccgagtgatagacccgcggcgctgtctgaagccggtcatcctaacagacggccccgagcgggtgattctggcggggccgatgcccgtgactgtagcctccgctgcccaacggcggggccgtgtggggagaaacccccagaaggaaaacgaccagtatatcttcaccggccagcccctgaacaacgacgaggaccacgcgcattggaccgaggccaagatgttactggataacatcaatacacccgaagggatcatcccagccttattcgagcccgagcgcgagaaaagcgccgcgatcgacggcgaatatagattgaaaggcgagtcgcgaaagaccttcgttgagctcatgcggcgcggggacctgcccgtatggctcgcccacaaagtcgcttccgagggcatcaaatatactgaccgcaagtggtgcttcgacggggaacgcaacaatcagatactagaggaaaatatggatgtcgagatctggaccaaggagggcgaaaagaaaaagctccgaccccgctggctcgacgcccgaacctactcagaccccttagccctgaaggagtttaaagacttcgcggccggccgcaagtccatcgcccttgacctggtgacggagatcggacgcgtgccgtcgcacctggcccaccggacccgaaacgccctcgataacctggtcatgctgcacacctccgaacacggcggccgtgcctatcgccacgccgtagaggagcttcccgagacgatggagacgctgctactcctgggcctgatgatactcctgaccgggggcgccatgctattcctcattagtggcaaagggatcggcaagaccagcatagggctgatctgcgtggtcgcttccagcggcatgctctggatggccgacgtgccgctccaatggatcgcgtcagccatcgtgctcgagtttttcatgatggtcctgcttatcccagagcccgaaaagcagcggacgccccaggacaaccaattagcctacgtggtgatcgggatccttactctcgccgcgatcgtcgcggcaaacgagatgggcctgctggagaccactaagcgcgatctgggtatgtcaaaagagccaggtgttgtctcgccgacctcatacctcgacgtcgacctccatcccgcatccgcctggacgctctatgccgtggccacgacagtaatcacccccatgctgagacacacgatcgagaactcaaccgcaaacgtctccctggccgccatagccaaccaggccgtggtgctcatgggcctagataaggggtggcccatctccaagatggaccttggcgtcccgttactggcgctggggtgttacagtcaggtgaacccattgaccctgaccgccgccgtgctgctcctggtgacgcactacgcgataatcggcccaggcctgcaggccaaagccacacgcgaggctcagaaaaggaccgccgccgggatcatgaagaatccaacggtggacggaatcatgacgatagacttggacccggtgatctacgacagcaagttcgaaaaacaactcggccaagttatgcttctcgtgttatgtgccgtgcagctcctcctgatgcggacttcgtgggccttctgcgaggccctgaccttggcgaccggtcccatcacgactctatgggagggctcacccgggaaattctggaacactacgatagccgtctcgatggccaacatcttcagaggctcgtacctcgccggggccggtctcgcgttctccattatgaagtccgtgggaacgggcaagcgcggcaccgggtcccagggcgagacattaggggagaagtggaagaagaagctgaaccagctcagcagaaaggagtttgacctgtacaagaagtctggcatcaccgaagtagatcgtactgaagccaaggagggtctgaagcggggagagatcacccatcatgccgtctcccgcggcagtgccaagctccagtggttcgtggagcggaatatggttatccccgaggggcgggtgatcgacctaggatgcggacggggcgggtggtcatactactgcgctggactaaagaaggtaaccgaggttagaggctacaccaaaggagggccagggcacgaggagcccgtcccgatgtcgacctacggctggaacatagtgaaacttatgtcaggaaaggacgtgttctaccttcccccggagaagtgcgacacgctgctgtgtgacataggcgaatcaagtcccagccccaccgttgaggagtccagaaccatccgcgtgctcaagatggtcgaaccctggctcaaaaacaaccagttctgcatcaaggtgctcaacccgtacatgccaaccgtcatcgagcatctcgagcgcttgcagcgaaagcacggcggtatgctggtgcgcaaccccctctctcggaacagcacgcatgagatgtattggataagcaatggtaccgggaacattgtctcaagcgtgaacatggtatcccgcctgttattgaacagatttactatgacccacaggcggcccacgatcgaaaaggacgtggacttgggcgcgggtacacggcacgtgaacgccgagccggagacccctaacatggacgtcatcggggagcggatccgccggatcaaggaggagcatagctcgacgtggcactacgacgaggagaacccctacaagacgtgggcctaccacggtagctatgaagtcaaggcaactggtagtgccagcagcatgatcaacggcgtggttaagttattgaccaagccatgggatgtggtgcccaccgtgacgcaaatggcgatgacagatactactccattcgggcagcagcgcgtcttcaaagagaaggtggacacgagaactccccgcccaatgcctggaaccaggaaggccatggagatcactgccgagtggctctggcgcaccctgggccggaataagcgcccccgtctctgcacacgcgaggagttcactaagaaggtgcgaaccaacgccgcgatgggggccgtcttcacggaggagaatcaatgggactccgccagggcggcggtagaagatgaggagttctggaaactggtcgatcgcgagcgggagctccacaagctcggcaaatgtggtagctgcgtgtataacatgatgggcaaacgggagaagaagctgggggagttcggcaaggctaagggctccagagccatctggtacatgtggctcggggcccgctatctcgagttcgaggcactgggctttttaaacgaggaccactggtttagccgggagaacagtttcagcggggtggagggcgaggggctccataagctgggctatatcctgcgcgacatttccaaaatccccggcggggccatgtacgcagacgataccgcaggatgggatactcggatcaccgaagacgatctccacaacgaggaaaagattacgcaacaaatggagccggagcaccgccaactcgccaacgccatctttaagctgacctaccagaacaaagtcgtgaaggtccagcggcccacgcccaagggtacagtcatggacatcatcagccgcaaggaccagcggggttccggccaggtaggaacgtacggcctcaacacctttaccaacatggaagtacagctgattcggcagatggagggggagggcgtacttagcaaggccgacctcgagaacccacatctcctggagaaggagatcacccagtggctcgagaccaagggggtggagcggctgaaacgcatggcgatatccggggacgactgcgtggtcaagccgatcgacgatagattcgcggatgcactgcttgcgctgaacgacatggggaaggtgcgcaaggacataccacagtggcagcccagcaagggctggcacgactggcagcaggtacctttctgctcgcatcatttccacgagctgatcatgaaggatggccggaaacttgtagtgccgtgccgaccccaggacgagctgatcgggcgtgcccgcatcagccaaggcgccgggtggagcctaaaagagacggcctgcctcggtaaggcctacgcccagatgtgggcgttgatgtacttccaccgccgtgacctccgcctagcctcaaacgccatctgctccgcggtacccgtccattgggtgcccactagccggactacctggtccatccacgcccaccaccagtggatgacgaccgaggacatgctgacggtgtggaaccgagtttggattgaggacaatccttggatggaagataaaacccctgtgacgacgtgggaagacgtgccgtatttaggtaagcgagaggaccagtggtgtggtagcctgataggcctggcaagccgcgccacctgggcacaaaacatcctgaccgccatccagcaggttcggtccctcatagggaacgaggagttcctggactacatgccatctatgaagcgattccggaaagaagaggaatccgaaggcgccatctggtag

SEQ ID NO: 26159 - RNA, 9873 nt, synthetic construct
  misc_feature 1..9873: note = derived and/or modified CDS sequence (opt11) from DENV-3__KC762691__SS-prME
  source 1..9873: mol_type = other RNA
acgagtctgtgcctcatgatgatgctccccgcaacacttgctttccacctcacatcacgagacggggagccccgtatgattgtggggaagaacgagcggggcaagtccctgttgttcaagacagcctccgggataaacatgtgcacgctcatcgccatggacctaggcgagatgtgtgacgataccgtaacatataaatgccccctgataaccgaggttgaacctgaagacatagactgctggtgcaacctcacatcaacctgggtgacttatgggacatgcaatcaggccggggaacaccggcgcgacaaacgctctgttgccctggccccccacgtgggcatggggctcgacacccgagcgcaaacctggatgagcgccgagggcgcctggcgccaggttgagaaagtcgagacgtgggccttccgacaccccggcttcaccatcctcgcgctgttcctggcccactatatcggcacgtccctcacacagaaggttgtgatcttcatactgttaatgctggtgactccctctatgactatgcggtgtgttggggtaggcaacagggacttcgtcgaagggctgtccggcgctacgtgggtggatgtggtactggagcacggcgggtgcgtgacaacgatggccaagaataagcctaccctcgacatcgagctacagaaaacagaagccacccaactggccaccctccggaaactgtgcatcgagggtaagataaccaacgtaaccacagacagccgctgccctacacagggagaagccattctgccggaagaacaggaccagaattacgtctgcaaacatacctacgttgaccgggggtggggaaacgggtgcggcctcttcggaaaagggagccttgttacctgcgccaaattccagtgccttgagctcatcgaagggaaggtcgtgcagcacgagaatcttaagtacaccgttattataaccgtgcatacgggagaccagcaccaggtgggcaacgagacacagggggtcaccgccgaaatcactccacaggccagcacagtagaggccatcctccccgagtacgggaccctcggtcttgagtgtagtccccggactggcttggacttcaatgagatgatcctcctgacgatgaaagacaaagcctggatggtgcaccggcaatggttctttgacctgcccctcccctggacaagcggcgccaccacagagaccccaacttggaacaaaaaggagcttctggtcacctttaaaaacgcccacgccaagaagcaggaggtggtggtgctcgggagccaagagggagcgatgcacacagccctgacaggtgcaactgagattcagacttccggcgggacctccatcttcgccggccacctcaagtgtcgcctcaagatggacaagctggagctgaaaggcatgagttacaccatgtgcagcaacgctttcgtgctaaagaaggaggtgtctgaaacacagcatggaactatcctgatcaaggtggagtacaagggcgaggacgcgccgtgtaagatcccgttcagcacagaagatgggcagggcaaggcccacaatggccgattaatcaccgcgaaccccgttgtgacgaagaaagaggaacccgtcaacattgaggccgagcccccgttcggtgagtccaacattatcatcggcataggggacaaggcgttgaaaataaactggtataagaagggcagttccatcgggaagatgttcgaagccaccgcccgcggcgcccggaggatggctatcctgggcgatacggcgtgggatttcgggagcgtgggtggagtcctgaacagcctcggcaagatggtccatcagatattcgggagcgcctacacggccctcttctctggcgtgagctggatcatgaaaataggtataggggtgctgctgacatggattgggctcaattccaaaaacacctcgatgtccttcagctgtattgttatcgggatcatcaccctgtacctgggcgccgtagtgcaggccgacatgggatgcgttataaactggaaaggcaaggagttgaagtgcggctccggaatcttcgtcactaacgaagtccatacgtggaccgagcagtataagttccaggcggacagccctaggcgtcttgctaccgcgatagcgggcgcctgggaaaacggggtctgcggcatacgctcgaccacgcggatggagaacttactatggaagcagatcgcgaacgagctgaactacatcctgtgggagaacaatataaagctcaccgtcgtggtgggagatacaatcggcgtgttagagcaggggaaacgaaccctgaccccacaacccatggaactcaagtacagctggaagacctggggtaaggcaaaaattgtgacagccgagactcagaactccagctttatcatcgacgggcccaacacgcccgagtgtcccaacgcctccagagcgtggaacgtctgggaggtcgaagactacggcttcggcgtcttcacaacgaacatctggctaaagctgagagagatgtacactcagctctgtgatcaccggctgatgagcgccgcggttaaagacgaacgcgccgtgcacgctgacatgggctactggatcgagtcgcaaaaaaacggcagctggaaactcgagaaggcttcactgattgaagtaaagacttgcacgtggcccaagtcccatacattgtggtctaacggcgtactggagtccgacatgatcatcccaaaatccctcgctgggcccatctcccagcacaactacagacccggctaccacacccagaccgcagggccctggcacctgggcaaacttgagttggatttcaattattgcgagggaactacggtggtcatcacggaaaactgtggagctcgtggaccaagcctgcggaccacgacagtctccggaaagttgattcatgaatggtgctgccgcagctgtactctgccgcccctccgctacatgggcgaggacggctgctggtacggcatggagatcagacctatcaatgaaaaggaggaaaacatggtaaaatcgctggtgtcggctggctccggaaaggtagacaatttcaccatgggagttttgtgcctggctatcctgttcgaagaggtcatgagggggaagttcgggaagaaacatatgatcgccggagtcctcttcacgttcgtgttactgctcagcgggcagatcacctggcgcgacatggccaggacattgatcatgatcggttccaacgcatctgaccggatggggatgggcgtgacttatttggccctaatagcgacctttaagatccagcccttcctcgctctggggttcttcttacggaaactgacctcccgcgagaacctgctcctgggagtcggcctggccatggcgacaacgctccaactgcccgaagacatcgaacagatggcgaacgggatcgccttggggctcatggccctgaaactgatcacccagttcgagacgtaccaactatggaccgcgctcgtatccctgatgtgttcaaatacaatcttcacgctcactgtggcctggcgcaccgctacgctcatcctagctgggatttccttgttcccggtctgccaaagcagtagcatgcgcaagaccgattggctgccaatgaccgtggccgcaatgggcgtgccgcccctacctctctttatcttctccctgaaggacaccctgaaacgccggagttggccgctcaacgagggggtgatggccgtcgggctggtatccatccttgcgagctccctcttgcggaacgacgtgcccatggccggcccgctggtggccgggggtttgctgatcgcctgttatgttatcaccgggacgtctgccgaccttaccgtcgaaaaggcagccgatgtgacgtgggaggaggaggccgagcaaactggtgtctcccacaatcttatgattacggtagacgacgatggaaccatgagaataaaggacgacgaaaccgagaatatcctgacggtgctgctcaagaccgccctgttgatcgttagcggcatatttccctactccattccggccaccctcctggtatggcacacctggcaaaagcagacccagcgcagcggtgtgctgtgggacgtaccgtctccccccgagacccagaaagctgagctcgaggagggggtgtaccggatcaaacagcagggcatcttcggaaagacccaggtgggcgtcggggtgcagaaggaaggtgttttccacacaatgtggcatgtcacacgcggcgccgtcctgacatacaacgggaaacggctggagccgaactgggctagtgtaaagaaagatctaataagctacggcggcgggtggcgcctgtccgcccagtggcagaagggggaagaggtccaggtaatcgcggtcgagccaggcaagaatcctaagaacttccagactatgcctggtatctttcagacgaccacgggcgagatcggcgcgatagccctcgatttcaagccggggacatcaggttctcctatcataaatagagaaggcaaggtggttggactttacggcaacggtgtagtgaccaagaacggggggtacgtaagcggtattgctcagaccaacgccgagcccgatggacccacccccgagttggaagaggaaatgttcaagaaaaggaacctaacgatcatggacctgcatcccggttccggaaaaacacggaagtaccttcccgctattgttcgggaggcaatcaaacgccgcctccggaccctcatcttagccccgacccgggtagtggccgccgagatggaggaagcgctgaaggggctgccaattcgataccagaccaccgccaccaaaagcgagcacaccggcaaggagatagtggacctcatgtgtcacgcgacattcacgatgcgactactgtcccccgtccgggtgcccaactataacctgatcatcatggatgaggcccacttcacggatccggcaagcatagcggcccgcgggtacatatcaacccgggtgggcatgggcgaagcagccgcgatcttcatgacggcaacaccacctgggacagctgatgccttcccacaaagcaacgctccaatccaggacgaggaaagggatatccccgagaggagctggaactctggtaacgactggatcacggactttgcgggtaagacagtctggtttgtgcctagcatcaaggcgggcaacgacatcgcaaactgtctgagaaagaatgggaaaaaggtgatacagctaagccgaaaaaccttcgataccgagtatcagaagacaaagctcaacgactgggacttcgtcgtaacgaccgacatatccgaaatgggtgctaacttcaaggcggaccgagtgatcgatccccgccggtgcctgaagccggtcatcctgaccgacgggcccgaacgcgtgatactcgcggggcccatgcccgtaactgtcgccagcgctgcccaacgccgaggccgtatcgggcgcaacccgcagaaggagaacgatcagtacatctttacgggccagcccctaaacaacgatgaagaccacgctcattggactgaggccaagatgctccttgacaacatcaatacgcctgaggggatcatccccgccctgttcgagcctgagcgggagaagtccgccgcaatcgacggtgagtaccgcctgaagggcgagtctcgaaagacattcgtcgagctcatgcggagaggggacctacctgtgtggctggcgcataaagttgcgtccgaagggatcaaatataccgatcgaaagtggtgtttcgacggcgagagaaacaaccagatcctcgaggaaaacatggatgtcgaaatttggactaaagaaggagagaaaaagaagctgcgcccccggtggctagacgccaggacgtacagcgatcccctcgcactgaaggagtttaaggacttcgccgcgggccgcaagagcatcgccctggacctcgtcaccgagatcggaagagtgccatcgcatctagcccaccgcacccggaatgccctagataacctcgtaatgctgcatacttcagagcacggaggtcgtgcgtatcggcacgcagtcgaggaattgcccgagacgatggagaccctcctgctcctcggtctaatgatcctgctcaccgggggagcaatgctgtttctaatttcaggcaagggggtggggaagacgagtatcgggctcatatgcgtggtcgcatcgagcggtatgttgtggatggccgacatccccctgcagtggattgcaagtgcaatcgtgctcgagtttttcatgatggtgctgctgatcccagaacccgagaaacagcgcaccccgcaggacaatcagctggcctatgtggttatagggatcttaaccctcgccgccatcgtggccgcgaacgagatggggctcctggaaaccacaaaacgggaccttggcatgagcaaggaaccaggggtcgtatccccgacatcgtacctagatgtggacctccaccccgcctccgcctggaccctgtacgccgttgcgaccaccgtgatcacgcccatgctccgccacacgatagagaactctactgcaaacgtatcattagcagcaatcgcgaaccaggcggtcgttctgatggggctcgacaaagggtggcccatctcaaaaatggacttaggtgtgccgctgctcgccctggggtgttactcccaggttaacccactaaccttgactgcggcggttctgctgctcgtgacccactacgccattatcgggcccggcctgcaggcgaaggcaacaagagaggcgcagaagcgcacggccgccggcatcatgaagaacccgacggttgatggcataatgaccattgatctagatccggtgatttacgactctaaattcgagaagcagctcggccaggtgatgctgctggtgctctgcgcggttcaactgttactaatgcgtacctcatgggccttctgcgaggctctgacgttagccaccggtccaatcacgacgttatgggagggaagccccgggaagttctggaacactaccatcgcagtgtcgatggcaaacatcttccgtggcagttatctggccggagcaggcctggccttctccatcatgaaatccgtagggaccggcaagcgcggcacaggcagccagggggaaacgctcggggagaaatggaaaaaaaaattaaaccaactgtcacgcaaagagttcgacctttacaagaagagtggcatcaccgaggtcgatcggacggaagcgaaggagggattgaagcgcggcgagatcacacaccacgccgtgtctcggggctccgcaaaactacagtggtttgtagaaaggaatatggtgatcccagaggggcgggtgatagacttgggctgcgggcgtggcggatggagctattactgcgccggtctaaaaaaagtcacagaggtgagagggtataccaaaggcgggccgggtcatgaggaacccgtgcccatgtctacctatggctggaacattgtaaagctaatgtcaggtaaggatgttttctacctaccgcccgaaaaatgtgacacactgctgtgtgacatcggtgagtccagtccctcgcccaccgtggaggagtcccgaaccatacgcgttctgaagatggtggagccctggctgaagaacaaccagttttgcataaaggtgctaaacccttacatgcccactgttatcgagcatctggaacggctacagcgcaagcatgggggtatgctggtgcggaaccccctgtcgaggaacagtacccatgaaatgtactggataagcaacggcaccggtaatatcgtgtcaagcgtaaacatggtgagccgtctcctgctcaaccggttcacgatgacttaccgacgtcccaccatcgaaaaagatgtcgacctaggcgccggaacccggcacgtcaatgctgagccggagacgccaaacatggatgtaattggggagcgcatccgacggatcaaagaagagcatagctccacctggcactacgacgatgagaacccctacaagacatgggcataccacggctcgtacgaagtgaaggccaccgggtccgcatcaagcatgatcaatggtgtcgtaaaactactgacgaaaccgtgggacgtggtccccaccgtgacacagatggcgatgaccgacacgaccccgttcgggcagcagcgggtattcaaggaaaaggtcgatacaaggacccccaagcctatgccaggtacgcgtaaggttatggagataaccgcagagtggctctggaggaccctgggccgcaacaagcgccccagactgtgtacccgcgaggagttcaccaagaaggtccgcacgaatgccgcaatgggtgcagtgttcacagaggagaatcagtgggactccgcgagagcagcagtggaggacgaggaattctggaagctggtcgaccgcgagcgggagctgcacaagctgggcaagtgcgggagctgtgtgtacaacatgatgggcaaacgcgagaagaagcttggggaattcggtaaagcaaagggctcccgagcaatttggtatatgtggctgggcgcgcgctacctggaatttgaagcattgggcttcctgaacgaggaccactggttctcgcgcgagaacagctactctggtgtggagggcgaggggctccacaagttgggctacatcctgagggacatttccaagattccaggcggtgccatgtacgcagacgacacggcgggatgggacacgcggataaccgaggacgacctacacaacgaggagaagattacacagcagatggacccagagcaccgccagctcgcgaacgcgattttcaagctgacctatcagaacaaggtcgttaaggtgcagcggccgacacccaaggggacagtcatggacattatctcgaggaaagaccaacggggctccggccaggtagggacctacggtttgaacacttttactaacatggaggcccaactcatacgccaaatggaaggagaaggagtgctgtctaagacggaccttgagaatccgcacctcttggagaaaaaaataacgcagtggttggagaccaaaggtgttgaacggttgaagcgcatggctatatccggggacgattgcgtggttaagccgatcgacgaccgcttcgctaacgcgctgttagcactcaacgacatgggcaaggtacgtaaggacatccctcagtggcagccatctaagggttggcacgactggcaacaggtacccttctgtagccaccacttccacgagctaatcatgaaggacggccggaagctggtagttccgtgccgtccccaggacgagctaatcggcagggctcgcattagccagggcgcaggatggtcgctgaaggaaaccgcttgtctcggcaaggcgtacgcccagatgtgggccctgatgtactttcacagacgggacctgcgtctggccagcaatgccatctgctctgccgtgcccgtacactgggtccctactagccgtactacttggtccatacacgctcaccatcagtggatgacgacggaggatatgcttaccgtatggaaccgcgtctggatcgaggacaacccgtggatggaggataagaccccagtcaccacgtgggaggacgttccttacctgggcaagcgcgaggaccaatggtgtggcagcctgatcggtctcaccagcagagcaacctgggcccagaacatcctgaccgcgatccaacaggttcgatccctgattggcaacgaggagtttctcgactacatgccctcgatgaagagattccggaaagaagaggagagcgaaggggccatttggtaa

SEQ ID NO: 26160 - RNA, 9873 nt, synthetic construct
  misc_feature 1..9873: note = derived and/or modified CDS sequence (opt11) from DENV-3__KC762692__SS-prME
  source 1..9873: mol_type = other RNA
accagcctgtgtctcatgatgatgctgcccgccacccttgcctttcacctcacttcccgcgacggagagcccagaatgatcgtggggaagaacgagcgcggcaagagcctgctgttcaagaccgcttccgggataaacatgtgcacccttattgctatggacctgggcgagatgtgcgacgacaccgtgacgtacaagtgccccctgatcacggaggtggagcccgaagacattgactgctggtgcaacctcacaagcacctgggttacgtacgggacttgcaaccaggccggtgagcatcggagggataagcggtccgtggccctggcgccccacgtgggcatgggactggacacccgcgcgcagacatggatgagcgccgagggcgcctggcgccaggttgagaaggtcgagacgtgggccttccgccaccccggattcaccatcctcgcgctgttcctggcgcactacatcggcacctccctcacccagaaggtagtgatcttcatactgctgatgctcgtaacgccctcaatgaccatgcggtgcgtgggggtagggaatcgtgatttcgtagagggactgtccggcgccacttgggttgacgtggtcctggagcacggtgggtgtgtgaccacgatggccaagaacaagcccacccttgacatcgagctgcagaagaccgaggccacacagctggcgacgctccggaagctgtgcatcgaaggcaagatcaccaacgttaccaccgactcgcgctgccccacgcagggagaagccatactgccggaggaacaggatcagaactacgtgtgcaagcacacttacgtggaccggggctggggcaacgggtgcggcctcttcggaaagggctctctggtgacctgcgccaaattccaatgcctggagctcatcgagggcaaggtcgtgcagcatgagaacctgaagtacaccgtgatcattacggtccacacgggcgaccagcaccaggtgggcaacgaaacccagggggtaaccgccgaaattacgccccaggctagcaccgtcgaggcgattctgcccgagtatggcacgctcgggttagaatgcagcccccggaccggccttgacttcaacgagatgatcttactgaccatgaagaacaaggcctggatggtgcacagacagtggttcttcgacctccctctcccctggacgagcggcgccaccacagagactcccacgtggaacaagaaggaacttctggtcactttcaagaacgcccacgccaagaaacaggaggtggtggttctagggtcccaggagggcgcgatgcataccgccttaaccggggccacggagatccagaccagcggcgggacctccatcttcgccggccaccttaagtgtcgcctcaagatggacaagctggagctgaagggcatgtcgtacgccatgtgctccaacgcgttcgtgctcaagaaggaggtgagcgagacccagcacgggacgatccttatcaaggtcgagtacaagggggaggacgccccctgtaagatcccgtttagcaccgaggacggccagggcaaggcccacaacggccgactgatcaccgccaaccccgtggtgaccaagaaggaggagccagtcaacatcgaggcggagcccccgttcggggagtccaacatcatcatcggcatcggcgacaaagccctgaaaatcaactggtacaagaagggcagctctatcgggaagatgtttgaggccacggccaggggcgcccggcgcatggcgatcctcggcgacaccgcctgggatttcggtagcgtgggaggggtgttaaactccctcggcaagatggtacaccagatttttggcagcgcctacaccgcacttttctccggtgtttcgtggattatgaagattggcattggagtgctgctcacctggatcggactgaactccaagaatacgagcatgtccttcagctgcatagtaataggaatcatcactctgtacctgggcgccgtggtgcaagcggacatgggctgcgtcattaactggaagggcaaggaactcaagtgcggctccgggattttcgttactaacgaagtgcacacctggacggagcaatacaagttccaggccgacagcccgaagcggcttgccaccgccatcgtcggcgcctgggagaacggtgtgtgcggcatccgttccaccacccgcatggagaatctgctctggaagcagatcgcgaacgagctgaattacatcttatgggaaaacaatatcaagctcacggttgtcgtcggggatatcatcggcgtgctggagcagggcaagcggaccctaacgccccagcccatggagctcaagtatagttggaagacctgggggaaggccaagatcgtcacggcagagatacagaattcctcattcatcatcgatggtccgaacacccccgagtgtcccaacgcctcccgcgcgtggaacgtctgggaagtggaggactacgggttcggtgtcttcacgacgaacatctggctgaagctgcgggagatgtacacgcagctctgtgaccaccgcttgatgtccgccgctgtaaaggatgagcgggccgttcacgccgacatgggctattggatcgagagccaaaagaatggatcctggaaactggagaaggcgagcttaatcgaggttaagacatgcacctggcccaagtcccatacactttggagcaacggcgtactggagtccgacatgatcatccccaagtccctcgccgggccgatctcgcagcataactaccgcccaggctaccacacccagacggccgggccgtggcacctggggaagctggagctcgacttcaactactgcgagggcaccaccgtggttattaccgagaactgtgggacgcgaggccctagcctgcgcaccaccacggtgtccgggaagttgatacacgagtggtgctgccggagctgcacgctgccgcccctccgctacatgggcgaggacgggtgctggtacggtatggagatacgaccaataaacgagaaggaggagaacatggttaagtcgctggtcagcgccggctccgggaaggtggacaacttcaccatgggcgtgctctgcctcgccatcctgttcgaggaagtgatgcgcgggaagttcgggaagaagcacatgatagcgggggtcctcttcatgttcgtactgctgctcagcggccaaataacctggcgggacatggcgcgcacccttatcatgattggctccaacgccagcgacaggatggggatgggcgtcacgtatctagccctcatagctaccttcaagatccagccctttctggcgttggggttcttcctgcggaagctcacctccagggagaacctgctcctgggcgtgggcctggctatggccaccacgttacaactgcccgaggatatcgaacagatggcgaacggtatcgcgctgggtctcatggtgctgaagctgatcacccaattcgagacctaccagctctggaccgccctggtcagcctgacttgctccaacaccatcttcacccttaccgtggcctggcgcactgccaccctgatcctggcagggacctccctcctgcccgtctgccaaagctcctccatgagaaagaccgactggctgccgatgacggtggcggccatgggcgtgccgcccctcccgctgtttatcttctccctgaaggacactctcaaacgccgcagctggcctctgaacgagggggtaatggccgtgggcttggtatccatcctcgccagctccctgctgcggaacgatgtccccatggccggccccctcgtggccggcggcctattaatcgcatgctacgttatcaccgggaccagcgccgacctcacggtcgagaaggccgccgacgtgacatgggaggaagaggcggagcagacgggggtgtcccacaacctgatgattaccgtcgacgacgacgggactatgcgcatcaaggacgacgaaaccgagaacatcctgactgtactcctgaagacggcgctgctcatcgtgagcggcatcttcccctactccatcccggcgaccctgctggtgtggcacacgtggcagaagcagacccagaggagcggcgtattatgggacgtgcccagcccgcccgaaacccagaaggccgagctggaggagggggtttaccgcatcaagcagcagggcatcttcgggaagacccaggtgggcgtgggggtccaaaaggagggcgtgttccacaccatgtggcacgtcacccggggcgccgtcttgacttacaacggcaaacgactcgagccgaactgggcgagcgtaaagaaagaccttatctcctacggaggtggctggcggctgagcgcccagtggcagaagggtgaggaggttcaggtcatcgccgtggagcccggtaagaaccccaagaacttccaaaccatgcccggcatcttccagacgatcactggagagatcggcgctatcgcgctggacttcaaaccggggacctccggcagtcctatcatcaacagggagggaaaagtggtcgggctctatggcaacggggttgtgaccaaaaatggcggctacgtgagcgggatcgcccagacgaatgcagagcccgacggcccgacccccgagctggaggaagagatgttcaagaaacgaaacctgaccatcatggacctccatcccggatcaggcaagactcgcaagtacctgccaacgatcgtgcgggaagccataaaacgacggctccgcaccttaatcctagcccccacccgggtggtcgctgccgaaatggaggaggccctgaaggggctgcccatccgctaccagaccacggccacaaagagcgagcacaccggcaaagagattgtggacctgatgtgccacgcgaccttcacgatgcggcttctatcccccgtgcgcgtccctaactacaacctgatcatcatggacgaagcgcacttcaccgacccggccagcatcgccgcccggggatacatcagcacccgcgtgggtatgggagaggccgccgccatcttcatgaccgccacgccgccggggaccgccgacgccttcccccagagcaacgccccgatccaggacgaggagcgggacatccccgagcgttcctggaacagcggcaacgactggatcaccgatttcgccgggaagaccgtgtggtttgtcccctccatcaaggccggcaacgatatcgccaactgcctgcgcaagaatgggaagaaggtgattcaactcagccggaagaccttcgacaccgagtaccagaagaccaagctgaatgactgggatttcgtagtgaccacggacatctccgagatgggcgcgaatttcaaggccgatcgcgtgatcgaccccagacgctgccttaagccggttatcctcaccgatggccccgagcgcgtcatcctggccggacccatgcccgtgaccgtggcctcagccgcgcaacgccggggcagggtcgggcggaacccgcagaaggagaacgaccaatacatctttacggggcagcccctgaacaacgacgaagaccacgctcactggaccgaggccaagatgctcctggacaacataaacacccccgaggggattatccccgccctgttcgaacctgaacgggagaaatccgccgcgattgatggcgagtaccggctcaagggcgagagccgcaagaccttcgttgaactgatgcggcgcggggacctgcccgtatggctcgcccacaaggtggcatccgagggtatcaaatacaccgatcggaagtggtgcttcgacggggagagaaacaaccagattttggaggagaacatggacgtggagatctggaccaaggagggcgagaagaaaaagctgcggccgcgctggctcgacgcccggacttactcggatccacttgctttgaaggagttcaaggacttcgccgccggacgcaaatccatcgccttggacttagtgacagagatcgggcgggttccgagccacctggcccatcggaccaggaacgcgctcgacaacttagtcatgctgcacacctccgagcacggcgggcgggcctacagacacgcggtcgaggagctccccgagacgatggagaccctcctgctgctgggcctcatgatcctgctgaccggaggcgccatgctgttcctcatttctggcaagggggtgggcaaaacctctatcgggctgatttgcgtggtcgcctccagtggcatgctgtggatggcggacatccccctacagtggatcgcctccgccatcgtgcttgagtttttcatgatggttctgcttatcccggagcccgagaagcagcggacaccccaggacaaccaactggcctacgtggtgatcgggatcctgactctcgccgcgatcgtggccgccaacgagatgggcctgctggagaccaccaagcgcgacctcggcatgagcaaggagcccggtgtagtgtccccgacaagctaccttgacgtggacctgcaccccgcgtccgcctggaccctatacgcggtcgccaccaccgtgataacgcctatgctgcggcacaccatcgagaacagtaccgccaacgtgtccctggcagcgatcgccaaccaggcagtcgtgctcatgggcctggacaaggggtggcctatttcgaaaatggacctgggcgtgccgcttctggccttagggtgctactcacaggtcaaccccctgaccttaacggccgcggttctgctcttagtaacccactatgccatcatcggtcccggccttcaggctaaggccaccagggaggcccaaaagagaaccgcggccggaatcatgaagaacccgacggtagatggcataatgaccatcgacttggacccggtgatctacgatagcaagttcgaaaagcagctgggccaggtgatgctgttagtcctgtgcgccgtgcagctgctcctgatgaggacctcctgggcgttctgcgaagccctgaccctcgcgacgggccccataaccactctgtgggagggcagccccgggaagttctggaacaccacgatcgccgtgtccatggctaacattttccggggcagctacctggccggggccggcctcgcgttctccatcatgaaatcagtcgggaccggcaagcgcggcaccgggagccagggcgagaccctgggggagaaatggaagaagaagctgaatcaactcagccgtaaggagttcgacctgtacaagaagtccggcatcacggaggtagatcgcaccgaggcaaaggaggggctgaagcggggcgagatcacccaccacgccgtgtcacgcggcagcgccaaactccagtggttcgtcgaacgtaatatggtgatccccgaggggcgggtgatcgatctgggctgcgggcgtggcgggtggtcctattactgcgcgggcttgaagaaggttaccgaggtgcgcggctacaccaagggcgggccggggcacgaagagcctgtgcccatgagcacgtacgggtggaacatcgtcaagcttatgtccgggaaggacgtgttctacctgccgccggagaagtgcgatacgttactgtgcgacattggcgagagttcacccagccccaccgtagaagagtcccggaccatccgcgtccttaagatggttgagccctggctgaagaacaaccagttctgcatcaaggtgctgaacccgtacatgccaacggtcatcgagcacctagaacggctgcaacggaagcacggcggaatgctggtgagaaaccccctcagccggaattccactcacgaaatgtactggatcagcaacggcactgggaacatcgtgtccagcgtaaacatggtgtcccgtctcctactcaaccgcttcaccatgacttatcgtcggcccaccatcgagaaggacgtcgacctgggcgccggaacccgccacgtgaacgccgaaccggagactcccaacatggacgtgatcggcgagcggatccgccggatcaaggaggagcacagctcaacctggcactacgacgacgagaacccctacaagacctgggcctaccacggcagctacgaagtcaaggccacgggtagtgcgagcagtatgattaacggcgtggttaagttgctgaccaagccctgggacgtcgtgcccacagtgacccagatggcgatgaccgataccacgccctttgggcagcagcgcgtattcaaggaaaaggtggacacacggacccccaagcccatgcccggcacacgcaagatcatggagatcacggccggttggctatggcggaccctgggacgcaacaagcggccccgcctctgcacccgggaggagttcaccaagaaggtgcgcacgaacgccgccatgggagcggttttcactgaggagaaccagtgggactccgcccgagccgccgtggaggacgaggagttctggaagctggtggatcgggagcgggagttacacaagcaagggaagtgcggcagctgcgtttacaacatgatggggaagcgggagaagaagctcggcgaattcggtaaggcgaaggggtcccgcgctatctggtatatgtggctgggcgcccggtacctggagttcgaggccctcgggttcctgaacgaggaccactggtttagccgcgagaactcctacagcggcgtggagggtgagggcctgcacaagctcggttacatcctacgggatatctccaaaatccccgggggtgccatgtacgcggacgacaccgccggctgggacactaggatcacggaagacgacctgcacaacgaggagaagatcacccaacagatggacccggaacaccggcagctcgccaacgccatcttcaagctgacctaccagaacaaggtggtcaaggtgcagcgccccacgcccaaggggacagtgatggacatcatcagtcggaaggaccagcgcggctccgggcaggtcgggacatacgggctgaacacctttaccaacatggaggcgcagctcatccgccagatggagggcgagggggtcctgagcaaaaccgacctggagaacccccacctcttagagaaaaagatcacgcagtggctggagaccaagggcgtggagcgcctgaaacgaatggctatctccggtgatgactgcgtcgtgaagccgatcgacgaccgcttcgccaacgccctgctggctctcaacgatatggggaaggttcgcaaggacatcccccagtggcagcccagcaagggttggcacgactggcaacaggtccccttctgcagtcaccacttccacgagctgatcatgaaggacgggcgcaatctggtggtgccgtgccggccccaagacgagctaatcggccgcgcgagaatcagccagggggctggctggtccctaaaggaaaccgcctgcctcggcaaagcctacgcccagatgtgggccctcatgtactttcaccgacgcgacctgcggctggcgagcaacgccatctgcagtgccgtccccgtgcactgggtgccaaccagccgtacgacctggtccatccacgcccaccaccagtggatgaccactgaaaacatgctcacagtgtggaatcgcgtgtggatagaggacaacccgtggatggaggacaagactcccgtgaccacctgggaggacgtcccctacctggggaaacgggaggaccagtggtgtggcagcttgatagggctcacctcccgggcaacctgggcccagaacatactcaccgccatccagcaggtccggtccctgattggcaatgaggagttcctagattacatgcctagcatgaagcggttccgtaaggaggaggaaagtgagggggccatctggtga

SEQ ID NO: 26161 - RNA, 9873 nt, synthetic construct
  misc_feature 1..9873: note = derived and/or modified CDS sequence (opt11) from DENV-3__JQ920481__SS-prME
  source 1..9873: mol_type = other RNA
acaagcctgtgcctgatgatgatgctgcccgcgaccttggcattccatctcactagccgggatggagagccccggatgatcgtggggaagaatgagcgcgggaaaagccttctgttcaagaccgcctccggcattaacatgtgtaccctcattgccatggacctgggggagatgtgtgatgacactgtgacctataagtgcccattaatcacagaggtggagcccgaggacatcgattgctggtgtaacctcacctccacctgggtgacctacggtacctgcaaccaggccggcgaacaccggcgcgataaacggagcgtagcgctggcgccgcacgttgggatggggctggacacccgcacccagacctggatgtccgccgagggcgcttggagacaggtggaaaaggtcgaaacatgggccttccgccaccccgggttcaccatcctcgccctattcctcgctcactacatagggacatctctcacgcaaaaggtggtgatcttcattcttctgatgcttgtcacgcccagtatgaccatgcgatgcgtgggagtgggcaaccgggacttcgttgaaggcctctctggcgccacctgggtggacgttgtccttgagcacggcggatgcgtgacgaccatggccaaaaacaaaccgaccctagacatcgagcttcagaaaaccgaagccactcagctcgctaccctccgcaaactatgcattgagggtaagatcaccaatgtgactacggactctcgctgccccacgcagggcgaggcgatcctacccgaagaacaggatcagaactacgtctgcaagcacacgtacgtggaccgcgggtggggcaacggatgcgggctctttgggaaggggtccctagttacttgtgccaagttccaatgcctggaaagcatcgagggcaaggcggttcagcacgagaacttgaagtacacagtgatcataaccgttcacacgggggaccagcaccaggtcggcaacgagacacagggggtgactgccgaaatcacgccgcaggcatcgaccgtcgaggcgatcctccctgaatacggcacgctggggttagaatgtagcccacggaccggactggatttcaacgagatgatcctgttgacaatgaagaacaaagcgtggatggtacaccgtcagtggttctttgacctgcctctcccctggacgtccggggcgacgacagagacgcctacctggaataagaaggagctactggtcacctttaaaaacgcccatgccaagaaacaggaggtcgtggtactgggcagtcaagagggtgcgatgcataccgcactcacgggggccactgaaatccaaaccagcggcgggacctcgatctttgcaggacacctgaagtgtcgtctgaagatggacaaactcgagttaaagggcatgtcttacgccatgtgcctgaacgccttcgttctcaagaaagaggtgtcggaaacgcagcacgggacaatactgatcaaggtggaatacaagggcgaggacgccccctgtaagatcccgttcagcacagaggacgggcagggtaaggcccataacggccggctgatcactgccaatcccatcgtcacgaagaaggaggaacccgtgaacatcgaggccgaaccgccgttcggcgagtccaacatcgtcatcggcatcggggacaaggccctaaagatcaactggtacaaaaagggctcatccatcgggaagatgttcgaggccactgcacgaggagcccggcggatggcgatactcggtgacaccgcctgggacttcgggagtgttgggggcgttctgaactccctgggcaagatggtgcaccaaatctttggaagcgcctacacagccctcttttctggcgtcagctggatcatgaagatagggatcggtgtattactaacgtggatcggcctcaattccaagaacaccagcatgtccttttcatgcatcgtgattgggatcatcacgctgtacctgggcgcggtcgtgcaagcggacatgggttgtgtaatcaactggaagggcaaggagcttaagtgcggctccggtatcttcgtcaccaacgaggtgcacacgtggaccgagcagtacaagttccaagccgacagccccaaacggctggcaacagccatcgcgggcgcatgggaaaacggcgtgtgcggcatccgctccactactcgcatggagaatctgctctggaagcagattgccaacgaactaaactacatcctgtgggagaacaacatcaaactcaccgtcgtggtaggggatgtaatcggcgtgctggagcagggcaaacggaccctgacgccccagccaatggagctgaagtacagttggaagacatggggcaaggccaagatcgtaaccgccgaaacccaaaatagtagtttcatcatcgacgggccgaacacccccgagtgcccatccgcgtcccgtgcctggaacgtctgggaggtagaggactacgggttcggtgtgttcacaaccaatatctggctgaagctgagagagatgtacacgcagctctgcgatcaccgcctgatgagcgccgccgtaaaagacgagcgggccgtgcacgcggacatgggctattggatagagtcccagaagaacggttcatggaaattagagaaggcgtccttaattgaggtcaagacctgcacttggcccaagagccacacgctttggagtaacggcgtcctggaaagcgatatgatcatcccgaaatccttggctggtcccatctcacaacataactatcgccctggctaccacacccagaccgcagggccgtggcaccttgggaagctggagcttgacttcaactactgcgagggcacaacggtagtgatcaccgagaactgcggcacccggggccccagtctgcgcaccactaccgtcagcggtaagctgatccacgagtggtgctgtcggtcctgcacgctgccgcccctacgctacatgggcgaggacgggtgttggtacggcatggagatccgcccgatcaacgaaaaagaggagaacatggtgaaaagccttgtgtcagcgggaagcggtaaggctgacaacttcacaatgggagttctctgcctcgccatcctgttcgaggaagtcatgcgcgggaaatttgggaagaagcacatgatcgccggggccctcttcacgttcgtcttactgctctcaggccagataacctggcgtgacatggcccacaccctgatcatgattggctcaaacgccagcgaccgtatggggatgggcgtgacctacctggctcttatagccaccttcaagatccaacccttcctggcccttggatttttcctccgcaagctgacatctcgcgaaaacctgctcctcggcgtgggcttggccatggccaccaccctacagctgcccgaggacatcgaacagatggccaacggtatcgccctgggactcatggccctgaagctgattacacagttcgaaacctaccagctctggactgcgctggtgagccttatgtgttcgaacacgatcttcacgttgaccgtcgcctggcggaccgctaccctgatcttagctgtcatcagcttactgcccgtgtgccaatcgtcttccatgagaaagacagattggttaccgatgaccgtcgccgcgatgggggtgccgcccctccccctgttcattttcagcctgaaggacaccttaaaacggcgctcctggcctctgaacgaaggcgtaatggccgtggggttggtgtcgatcctcgcctccagcttcctgcgcaatgacgtccccatggcaggcccgctggttgccggagggttactcattgcgtgctacgtaatcaccggaacgtccgccgacctgaccgtcgagaaggccgccgacgtgacctgggaggaggaagccgagcagactggtgtgagccacaacctcatgatcactgtcgacgacgacggaaccatgcgcattaaggacgacgagaccgagaacatcctgactgttctgctcaagaccgcgctgcttatcgttagcgggatcttcccctactctatccctgccacactactggtctggcatacctggcagaaacaaacccagcgcagtggcgtgctctgggatgtgccctcaccgcccgagacccagaaggcagagctagaggaaggcgtataccgcatcaagcaacagggcatcttcggcaaaacccaggtaggggtgggcgtccagaaagaaggcgtgttccacacaatgtggcatgtaacccgcggcgctgttctgacccacaacggcaagcgactggaaccgaactgggcgaacgtgaagaaagacttaatctcctatgggggtgggtggaagctgagcgcgcagtggcagaagggagaagaagtgcaagtcatagcggtggaaccgggcaagaaccccaagaacttccagacgatgccagggatcttccagaccactaccggcgagatcggggccatcgccttagacttcaagcctggcacctccggatcccctatcatcaaccgcgaaggaaaagtggtcgggctctacgggaacggcgtggtgaccaaaaatggagggtacgtcagcgggatcgcacaaaccaacgcggagccagacggaccgacccccgagttggaggaggaaatgttcaagaagcggaacctgacgatcatggacttacaccccggctccgggaagacccgcaaatatctccccgccatagtccgggaggccatcaaacgtcggctaaggaccctgatcctcgccccgacccgggtggtggcggccgagatggaggaggccctgaagggccttcccatccgctatcagacgaccgccaccaagagcgagcacacggggcgagaaatagtggatttgatgtgccacgcgacgtttaccatgcggctgttgtcccctgtacgtgttcctaattacaacctcattgtgatggacgaggcgcacttcacggaccctgccagcatcgcagcccgcggctacatctccacgcgggtggggatgggcgaagcggctgcaattttcatgacggctacgcctcccggaaccgccgatgcgttccctcagagcaatgctccgatacaggacgaggaacgtgacatccccgagcgctcctggaatagcggtaacgaatggatcaccgacttcgccggaaagacggtctggtttgtgccatccatcaaagcaggaaacgacatcgccaattgcctgcgcaaaaacggcaagaaggttattcagctaagcaggaagacctttgacaccgaataccagaagaccaagctcaacgactgggactttgtcgtcaccaccgatatatcagagatgggggcgaacttcaaagctgaccgggtgatcgaccctcgccggtgccttaagccggtcatcttaaccgacggcccagagcgcgtgatcctcgccggccccatgccggttacagtcgcatcggccgcgcagcggcgcggacgagtgggccggaacccacagaaggaaaacgatcagtacattttcactgggcaaccgctgaacaacgacgaggaccatgcgcactggacggaggccaagatgctcctcgacaacatcaacactcctgagggaattattcctgctctgtttgaacctgagcgggagaagagtgcagcaatcgacggcgagtaccgcctgaagggcgagtcaagaaagaccttcgtcgagctcatgcgccgcggtgacttacccgtttggctggcccataaagtggccagcgagggaatcaagtatacggaccgcaagtggtgcttcgatggcgagcggaataatcagatactcgaagaaaatatggatgtcgaaatctggacgaaggaaggcgagaagaagaaacttcgtcccaggtggctggatgcacgcacctacagcgacccgctcgccctcaaggagttcaaggattttgccgccggccggaagtccatcgcgctggacctcgttacagagatcgggcgagttccgagccatctagctcaccgcactcgtaatgctctagacaacctcgtcatgctgcacacgagtgaacacggaggccgtgcctaccggcacgccgtggaggaactaccggagaccatggaaaccttactcctgttggggctgatgatactgctcaccggcggagccatgctgttcctgatctccgggaaaggcatcgggaagacaagcatcggactcatttgcgtggtcgcgtcctccggcatgctgtggatggcggacgtgcctctgcagtggatcgccagtgccatcgtgctcgagtttttcatgatggtacttctgataccggagcccgagaagcagcgtacgccgcaagacaaccagttggcatacgtggtgataggaatcttaaccctcgccgcgattgttgcagccaacgagatggggttgcttgagactactaagcgcgacctgggcatgtctaaggaacccggtgtggtctcacctaccagctacctcgatgtcgatctgcaccccgcctccgcctggacgctgtacgccgtggccaccacggtgataaccccgatgctgcgccataccatcgagaactcaactgcgaacgtcagtctggcggcgattgccaatcaagcagtggtgctgatggggctggataaaggttggcccatctctaagatggatctgggggtgccactcttggcattgggctgctacagccaggtcaaccccctaacgctcacggccgcggttctcctactcgtaacccactacgccatcatcggacctggcctgcaggctaaagccactagggaggcgcagaaaaggacggccgccgggatcatgaaaaaccccaccgtggacgggatcatgacgatagaccttgaccccgtgatatacgatagcaagttcgagaagcagcttggccaggtcatgcttctggtgctgtgtgccgttcaactgcttttgatgcggacctcctgggcgttctgcgaggccctgacgctcgcaaccgggcctataaccaccctctgggaagggtcacccggcaagttctggaacacaacgatcgcggtttccatggccaatatcttccgggggagttaccttgccggcgcggggctggccttctccatcatgaaaagcgtgggtaccgggaaacggggtacaggctcacagggggagaccctcggcgagaagtggaagaagaagttaaaccagctgagccgcaaggagtttgatctttacaaaaagagcggcatcaccgaggtggaccgaaccgaagcgaaggaggggctgaagcgcggggagatcacccatcatgccgtctcccgcggctcagccaagctgcagtggtttgtcgaacgaaatatggtgatccccgagggccgggtcatcgaccttgggtgtgggcgcggtggctggtcctactattgcgcggggcttaagaaagtaactgaggtacggggctatacgaagggcgggccgggccacgaggagcccgtccccatgtccacgtacgggtggaacatcgtcaaactgatgtccggaaaggacgtgttctacctcccgcccgagaagtgcgacaccctgctgtgcgacatcggcgagtcgtctcccagccccacagtcgaggagtctcgcacaatcagggttctgaagatggtggagccgtggctcaagaacaatcagttctgtattaaggtcttgaatccgtatatgcccaccgtgatagagcacctggaacgcctccaacgcaagcacggtggcatgctggtccggaatcccctctctcgtaacagcacccacgagatgtactggatctcaaacggaaccggcaacattgtctccagcgtgaacatggtgtcccgtctcctgctgaatcgctttactatgacccacaggcgacccaccattgaaaaagacgtggatcttggagccggcacccggcacgtgaacgccgagccggagactcccaacatggatgtcatcggcgaacgaatacggcgcatcaaggaggaacacagcagcacctggcactacgacgacgagaacccttacaagacctgggcctaccacgggagctacgaggtgaaggccaccggttccgcctcgtctatgatcaacggggtggtcaagctgctcacgaaaccctgggacgttgtacccatggttacccagatggcaatgaccgacaccactccgttcgggcagcagcgtgtgttcaaggagaaagtcgacacgcggacgccccgtccgatgcccggaacccgcaaggtcatggagatcacagcggaatggctctggaggactctaggccgtaacaagcgcccacgtctgtgcacacgcgaggaatttatcaagaaagtccgcacgaatgccgcaatgggcgccgtcttcacagaggagaaccaatgggactccgccagggccgccgtcgaggacgaggagttctggaagctcgtcgaccgcgaacgcgaactgcacaagctggggaagtgcggaagctgcgtgtacaacatgatggggaaacgggagaagaagctcggcgagttcgggaaggcgaagggatcgcgcgccatctggtacatgtggctgggagcacgatacctggagttcgaggccctaggtttcctcaacgaggatcactggttcagcagggaaaactcctactctggcgtcgagggggagggcctgcacaagctcgggtacatcttacgagatatctcaaagattcccggcggcgccatgtacgcggatgacactgccgggtgggacacacggataaccgaagacgacctccataacgaggaaaagatcacgcagcagatggacccggagcaccggcagttggccaacgccatcttcaaactgacctaccagaataaagtggtaaaggtccaacggccgaccccgaaggggaccgtgatggacatcatctcaagaaaggaccagcgagggtccggccaggtgggcacgtatgggctgaacacctttaccaacatggaagcacagctaatcagacagatggaaggagagggggtactgagcaaagcggacttagagaacccccatttgttggagaagaaagtgacccagtggttagagaccaaaggggtggagcgcctaaaacggatggctatcagcggggacgattgcgtcgtaaagcccatcgatgaccggttcgcaaacgccctgttagcgctcaacgatatggggaaagttcgtaaggacatcccccagtggcagccaagcaagggctggcatgactggcagcaggtccccttctgctcccaccactttcacgaactgataatgaaggacgggcgtaaacttgtagtaccgtgccggccccaggacgaactcatcggccgcgcacggattagccaaggggccggctggtccttgcgcgagacggcctgcctggggaaagcctacgcgcagatgtgggcactgatgtacttccaccgccgggacttacgtctggcgagcaatgctatctgttccgccgtccccgtgcattgggtgcccaccagccggaccacatggagtattcatgctcaccatcagtggatgactacagaagacatgttgaccgtctggaaccgagtgtggatcgaagataacccgtggatggaggacaagactcccgtgacgacctgggaggatgtcccctacttaggcaagcgggaggaccagtggtgcggcagtctgatcgggctcaccagccgagcgacgtgggctcagaacatcctgactgccatccagcaggtccggtctctgatcggcaacgaagagtttctggactacatgccttctatgaagagatttaggaaggaggaagaatccgagggggcgatctggtga

SEQ ID NO: 26162 - RNA, 9873 nt, synthetic construct
  misc_feature 1..9873: note = derived and/or modified CDS sequence (opt11) from DENV-3__JQ920483__SS-prME
  source 1..9873: mol_type = other RNA
accagcttgtgcctcatgatgatgctgccggctaccctggccttccacctcaccagccgtgatggggagccccggatgatcgtggggaagaacgagcgggggaagagcctgcttttcaagaccgccagcgggatcaacatgtgcaccctgatcgccatggacctgggcgagatgtgcgatgacaccgtgacttataagtgccccctgatcactgaggtggagcccgaggacatcgactgttggtgtaatcttaccagcacctgggtgacctacgggacttgcaaccaggctggcgagcatcggcgcgacaagaggtccgtggccctagcgccgcatgtgggtatgggactggacacccgcacccagacctggatgagcgcggagggagcctggcgccaggtggaaaaggtcgagacctgggccttccgacaccccgggttcacaatcctcgccttattcctcgcacattacatcggcacttccctcacgcagaaggtggttatcttcatactgctgatgctcgtaacaccgagcatgaccatgaggtgcgtgggggtgggcaatcgggacttcgtcgaaggcctgtccggggccacttgggtagatgtggtcctagagcacggggggtgcgtgacgaccatggccaagaacaagcccacgctcgacatcgagctgcagaagaccgaggccacgcagctggcaaccctccggaagctgtgcatcgagggcaagatcaccaacgtgacaacggacagccgctgccccacacagggcgaggcgatcctgcccgaagagcagaaccagaactacgtctgcaagcatacatacgtggaccggggttggggcaacgggtgtggcttgttcggtaagggctccctggtgacctgcgccaagtttcagtgcctggagagcatcgagggaaaagccgtccagcacgagaacctcaagtacacggtgatcatcaccgtccacacaggggaccagcaccaagtcggcaatgagacccagggggtgacggccgaaattacgccccaggcgtccaccgtggaggcgatactgcccgagtacgggaccctgggcctcgagtgcagcccccgcaccggcctggacttcaacgagatgatcctgctcacgatgaagaacaaggcctggatggtgcaccggcagtggttcttcgacctgccgctgccctggacctctggtgcaaccactgagacgccgacatggaacaagaaggagttgctggtcaccttcaagaacgcccacgccaagaagcaggaggtcgtagtgctcgggagccaggagggcgcgatgcacacggccctcacgggggccacggagattcaaacttccggtgggacttcaatcttcgccggccacctgaagtgccgcttaaaaatggacaaattggagttgaaaggcatgtcctatgctatgtgcctgaacgctttcgtcctcaaaaaagaggttagcgagacgcagcacgggaccatactgataaaggtcgagtacaagggcgaggacgcaccatgcaagatccccttcagcaccgaggacgggcagggtaaagctcacaacggccggctgattaccgccaacccgatcgtgacgaaaaaggaagagcccgtcaacatcgaggcggagccaccctttggcgagtccaacatcgttatcgggatcggggacaaagcactgaagattaactggtacaagaagggcagctccatcggtaagatgttcgaggccaccgcccggggggcccggcgcatggcaatcctcggcgacactgcatgggacttcgggagcgtcggcggggtcctgaactccctgggcaagatggtgcaccagatctttgggtcggcctataccgccctcttctctggcgtcagctggataatgaagatcggcatcggagtgcttctgacgtggattggactcaattccaagaacaccagcatgtccttcagctgtatcgtgatagggatcatcaccctgtacctgggcgccgtcgtgcaggctgacatggggtgcgtaattaactggaaaggcaaggagctgaagtgcggctccgggatcttcgtgaccaacgaggtgcacacatggaccgagcaatacaagttccaggccgacagtcccaagcggctggcgaccgccatcgccggcgcgtgggagaacggggtctgcggcatccgctccaccacgcgcatggagaacctgctctggaagcaaatcgccaacgagctgaactacatcctctgggagaacaacatcaaactcaccatcgtcgtaggggacgtgatcggtgtcctggagcagggcaaacggaccctgacaccccagccaatggaactcaagtactcttggaagacttggggaaaggccaagatcgtgacggctgagacccagaactccagcttcatcatcgacgggcccaacacccctgagtgcccctcggcctcccgcgcctggaacgtttgggaggtcgaggactatggctttggcgtgttcacgaccaatatttggctgaagcttcgggagaagtacacccaactctgtgatcaccgcctgatgagcgccgccgtgaaggacgaacgggccgtccacgcggacatgggctactggatcgagtcccagaagaacgggagctggaagctcgagaaggcctccctcatcgaggtgaagacctgtacctggcccaagagccatacgctgtggtccaacggcgtgctggaaagcgacatgattatcccgaaatccctcgcagggcccatcagccagcacaactaccgccccggctaccacacccaaaccgccgggccgtggcacctgggcaagctggagctcgacttcaactactgtgagggcaccacggtcgtaatcaccgagaactgcgggatcaggggcccgagcctgcggactaccacggtgagcggtaagcttatccacgagtggtgttgccggtcctgcaccctgccgcccctccgctacatgggcgaagacgggtgctggtacggtatggagatccggccgatcaacgagaaagaggaaaacatggtcaagtcgctggtgtccgccggcagcgggaagaccgacaatttcaccatgggcgtgctatgcctggcgattcttttcgaggaggtcatgcgcgggaagttcggcaagaagcacatgatagcgggggcccttttcacgtttgttctgctgctatccggccagatcacctggcgggacatggcccataccctaatcatgatcggtagcaacgcctccgatcgcatggggatgggcgtgacctacctggcgctcattgccactttcaagatccagccctttctggccctggggttctttctccgaaaattgaccagccgggagaacctgcttctgggcgtcggcctggctatggcgaccaccttgcagctgcccgaggacatcgagcaaatggccaacggaatcgccctggggctcatggccctgaagctgatcacgcagttcgagacctaccagctctggaccgccttgatcagcctaatgtgttccaacaccatcttcactctcaccgtggcgtggcggaccgccaccctgatcctggccgtgattagcctcctgcccgtctgccagtcctcctccatgagaaagacggactggctgccgatgaccgtggccgccatgggggtgccgcctctccccctgttcatcttcagcctgaaggacaccctaaagcggcgctcctggccgttaaacgagggcgtcatggcggtggggttagtctccatactcgcctccagctttttgcgtaacgacgtgcccatggccggtcccctggtggcaggagggctcctgattgcctgttacgtcatcaccggcacgagcgcggacctgaccgtggagaaggccgccgatgttacctgggaggaagaggccgagcagaccggggtctcgcacaacctcatgatcactgtggacgatgacggcaccatgcggatcaaggacgacgaaaccgagaacatcctgaccgtgcttctcaagaccgccctgcttattgtctccgggatcttcccctatagcatcccggcgacgctcctggtgtggcacacttggcagaagcagacacagcgctctggcgttctgtgggacgtcccctccccgcccgagacccaaaaggccgagctcgaggaaggcgtttaccggatcaaacagcaggggatcttcggcaagacccaggtgggggtcggcgtgcagaaggagggcgtgttccacaccatgtggcatgtcacccgcggtgccgtgttgacccacaatgggaagcggctggagccgaactgggctaacgtaaagaaggacttgatctcatacgggggcgggtggaagctaagcgcgcaatggcagaagggggaggaggtccaggtcatcgccgtggaacccgggaaaaatcccaagaacttccagacgatgcccggtatcttccagactaccaccggcgagatcggggccatcgccctcgacttcaagcccggcacgtccggaagccccatcatcaacagagagggcaaggtcgtgggcctgtacggaaacggtgtggtcaccaagaacgggggctacgtcagcgggatcgcacaaaccaacgctgagcccgatggcccgaccccagagttagaggaggagatgtttaagaagcggaacttgacgatcatggacctccaccccggctccgggaagacccgcaagtacctcccagccatcgtgcgcgaagccattaagcggcggctccgaaccctgatactcgcacccacccgggttgtggccgcagagatggaggaggccctgaagggcctgcccattcgctaccagaccacggccactaagagcgagcacaccgggcgggagatcgtggacctgatgtgccacgcaacgtttaccatgcgcctactctcccccgtcagggtgcccaactacaacctaatcgtgatggacgaggcccatttcaccgaccccgcgagcatcgccgcccggggctacatctccacccgggtcggcatgggcgaggccgcggccatcttcatgacggccactccgcccggtaccgccgacgcctttccccagagcaacgcgccgatccaggatgaggagcgcgacatcccggagcgctcctggaacagcgggaacgagtggatcactgatttcgcgggcaagacggtgtggtttgtgccctccatcaaggccggcaacgatatcgccaactgcctgcgcaagaacgggaagaaggtcatccagttatcccgcaagacctttgacaccgagtaccagaagacaaaactcaacgactgggacttcgtggtgacgaccgacatctccgagatgggggccaactttaaggcggaccgggtcatcgacccccgccggtgtctgaagccggtgatcttaacggacggccccgagcgcgtgatcttggccggccccatgcccgtcaccgtggcgtcggcagcacaacggcgcgggcgggtgggccgcaactcccagaaggaaaacgaccagtacatcttcaccgggcaaccgctaaacaacgacgaggaccacgcccactggaccgaggcgaagatgctgctcgataacataaacacacccgaaggaatcatccccgctctgttcgagcccgaacgggagaagtccgcagctatcgatggggagtaccgcctgaagggcgaatcacggaagaccttcgtcgagttgatgcgccggggcgacctgcctgtatggctggcacacaaggttgccagtgaagggatcaagtacacagaccgcaagtggtgcttcgacggtgagcggaacaaccagatcctcgaggagaacatggacgtcgagatctggacgaaggagggggagaagaagaagctgcgcccccggtggctggacgcccgcacgtattccgatcccctcgccctgaaggagtttaaggacttcgcggccggtcggaagagcattgcgctggacctcgttaccgagatcggccgcgtgccctcccacctggctcaccgcaccaggaacgccctggataacctcgtgatgctgcacacgagcgagcacgggggccgcgcgtaccggcacgccgtcgaggagctgccagagaccatggagaccttactgctgctaggtctgatgatcctgctcaccggcggggcgatgctgtttctgatctccggcaagggcatcggaaagacgtccatcgggctcatctgcgtcgtggccagctccgggatgctgtggatggccgacgttcctctgcagtggatcgcgtcggccatcgtcctcgagttcttcatgatggtactgctgatcccggagccagagaagcagaggacgccccaggacaaccagctcgcctacgtcgtaatcggcatcctgaccctggctgccatcgtggcggccaacgaaatggggctcttggagactacaaagcgggacttggggatgagcaaggagcccggtgtggtcagccccacctcctacctcgatgtagacctacacccggccagcgcctggaccctgtacgcggtggcgaccacggtcatcacccccatgctcaggcatactatcgagaattccaccgccaatgtgagcctggcagccatcgcgaaccaggcagtggtcctgatgggcctcgacaagggctggcccatttcaaagatggacctgggggtgcccctgctcgccctgggctgctacagccaagtaaacccactgacgctcaccgccgccgttcttctgctcgtgacccactacgctatcatagggccaggcctgcaagccaaggccacccgggaggcccagaagcgtacggctgcgggcatcatgaaaaaccctacggtggacggtataatgaccatcgacctggatcccgtcatctatgactccaaattcgaaaagcagctcggccaggtgatgctgttagtgctctgcgcggtccagctgctgctaatgcggaccagctgggccttctgtgaggcgctgacgctggcaacagggccgatcaccaccctctgggaggggtcccccggcaagttctggaacacgaccatcgccgtgtccatggccaacatcttccgcgggtcgtacctggccggcgccgggctagcgttctcaataatgaagtccgtgggcactgggaagaggggcaccggcagccagggagagacgctcggcgaaaagtggaagaagaagctgaatcagctgagccgcaaggagtttgacctctataaaaagtccgggatcaccgaggtggaccggaccgaggccaaggagggtctgaagcgcggtgagatcacccaccacgccgtaagccggggctcggccaagctgcagtggtttgtggagcgcaacatggtcatacccgagggccgggtcatcgacctcgggtgtggacgcgggggctggagctactactgcgccggcctgaagaaggtcacagaggtcaggggctacaccaaaggaggccccggccacgaggagccggtgcccatgtccacatatggctggaacatcgtgaaacttatgagcgggaaggacgtcttctacctgccgcccgagaagtgtgacaccctgctttgcgacatcggggagtccagcccgtcccccaccgtggaggagagccgcaccatccgggtgcttaagatggtcgagccgtggctcaagaacaaccaattctgcatcaaagtgctgaacccctacatgccgaccgtgatcgagcacctcgaacgcctccagcgcaagcacggcggcatgctggtgcgtaaccccctctcccgcaactctacccacgagatgtactggatctccaacgggaccggcaacatagtgtcatcggtgaacatggtctcccggctgctgttgaaccgcttcacgatgacccatcggcgccccaccatcgagaaggacgtggacctcggggcgggaacacggcacgtgaacgccgagcctgagacgccgaacatggatgttatcggcgagcgcatccgacgcatcaaggaggagcattccagcacgtggcactacgatgacgagaacccctacaagacatgggcctaccatggttcctacgaagtgaaagccacaggcagcgccagctcaatgatcaacggggtcgtgaagctgctgacgaagccctgggacgttgtgccgatggtgacccagatggcgatgacagacaccacgcccttcggccagcagcgggtgttcaaggagaaggtcgacactagaacaccccggcccatgcctgggaccagaaaggtgatggagatcaccgccgagtggctctggcggaccctaggccgaaacaagcgaccccgcctgtgcacccgggaagagttcataaagaaggtccgcaccaatgccgccatgggcgcggtcttcaccgaggagaatcagtgggacagcgcccgagccgccgtggaggatgaggagttttggaagctcgtggaccgagagcgcgagctgcacaagctgggcaagtgcggctcctgtgtctacaatatgatggggaagcgtgagaagaagctcggcgagttcggtaaagccaagggaagccgcgcaatttggtacatgtggctgggcgcccggtacctagagttcgaggccctcgggttcctgaatgaagaccattggttcagccgcgaaaacagccactccggcgtggagggggaaggcctgcacaagctcggatatatcttgcgggacattagcaagatcccaggcggcgccatgtacgccgacgataccgcgggttgggacaccaggataaccgaggacgacttacacaatgaggagaagatcacgcaacagatggatcccgaacaccggcagctcgcgaacgctatctttaagctgacataccaaaacaaggttgtcaaagttcaacgcccgacccccaagggcacagttatggacatcatctcccgcaaggaccagcgcggatcaggccaagtcggcacctacgggctgaacaccttcaccaacatggaagcccaactaatccggcagatggagggggagggggttctatccaaggccgacctggagaaccctcacctcttagagcgcaaggtgacccagtggctggagaccaaaggcgtcgagcggctcaagcgcatggcgatctccggggacgattgcgtggtgaagcccatcgacgaccggttcgccaacgccctgctagccctcaacgacatgggcaaggtccgcaaggacatcccgcagtggcagccctccaagggctggcacgactggcaacaggtcccgttctgctctcatcactttcatgagctgatcatgaaagacgggcggaagttagtggtcccctgccgcccgcaagacgagctcataggccgagcacgcatctcccaaggggcgggctggagcctgcgcgagactgcctgcctggggaaggcctacgcccagatgtgggcgctcatgtatttccaccggcgcgatcttcggctagcctccaacgccatctgcagcgccgtgcccgttcactgggtccccacctcccgcactacctggagcatccacgcacaccatcagtggatgaccactgaggacatgctaacggtgtggaacagagtgtggattgaagacaacccatggatggaggacaagaccccggttacgacctgggaagacgtcccttacctgggaaagcgcgaggaccagtggtgcggcagcctaattgggctcaccagccgggcgacctgggcccagaatattctaacggccatccagcaggtccgcagcctcatcgggaacgaggagttcctcgactacatgcccagtatgaagcgtttccgcaaagaggaggagtcagagggggccatctggtga

SEQ ID NO: 26163 - RNA, 9873 nt, synthetic construct
  misc_feature 1..9873: note = derived and/or modified CDS sequence (opt11) from DENV-3__JQ920482__SS-prME
  source 1..9873: mol_type = other RNA
accagcctctgcctcatgatgatgcttcccgccactctggccttccacctcacctccagagatggcgaaccccggatgatcgtggggaagaacgaacggggcaaaagcctgctgttcaagaccgcctcagggatcaacatgtgcaccctgatcgcgatggacctcggcgaaatgtgcgacgataccgtgacctacaagtgccctctgatcaccgaggtggagcccgaagacatcgactgttggtgcaacttaacctccacctgggtgacctacggaacctgcaaccaagcaggcgagcaccggcgggataagcggagtgtggccctggcgccccacgtgggcatggggctggacacacgtacccagacctggatgagcgcggagggcgcctggcgccaggtggaaaaagtcgagacctgggccttccgtcatccggggttcacaatcctagccttattcctggcccattatatcgggacctcactcacgcagaaagtggtgatattcatcctgttgatgctcgtcacccccagcatgaccatgcggtgcgtaggggtaggcaaccgcgacttcgtcgagggcctgtctggggccacctgggtggacgtggtcttggagcacggcgggtgcgtgacgacgatggccaagaacaagcctaccctcgacatagagcttcagaagactgaggccacgcagctggccacccttcggaagctgtgtatcgagggcaagatcaccaacgtaaccactgacagccgctgccccacccagggcgaggcgatcttgcccgaggagcaggaccagaactacgtctgcaagcacacctacgtggaccgggggtggggcaacgggtgcggcttgtttgggaagggctctcttgtgacctgcgccaagtttcagtgcctggagagcatcgagggcaaggccgtgcagcacgaaaacctcaaatacacggtaatcatcactgtgcacaccggcgaccagcaccaggtaggcaacgagacccagggggtcacggccgagatcacgccccaagcctctaccgtcgaggcgatcctgcccgagtatggtaccctggggctcgagtgtagcccccgtaccggcctggacttcaacgagatgatcctcctcacgatgaagaataaggcatggatggtccaccggcagtggttcttcgatctgccgctgccctggacatcgggtgccaccaccgagacgcccacctggaataagaaggagctcctcgtgaccttcaagaacgcccacgccaagaagcaggaggtggtcgtcttaggtagccaggagggcgcgatgcacaccgccttaactggggccaccgagatccagacctccggtgggacctcaatcttcgccggccacctaaagtgccgcctgaaaatggataagttagagctgaagggcatgtcatacgccatgtgtctgaacgcgttcgtcctcaagaaggaggttagcgagacgcagcacgggaccatcttaatcaaggttgagtacaagggcgaggacgccccttgcaagatccctttcagcaccgaggatgggcagggcaaggcccacaacggccgcctgattactgctaacccgatagtcacgaagaaggaggagccagtgaacatagaggcggagccgcccttcggggagtccaacattgtcatcggcatcggggacaaggccctgaagattaactggtacaaaaagggcagctctatcgggaagatgttcgaggccaccgcccgcggcgcccgtcgaatggcgatcctcggcgataccgcttgggacttcggttcggtcggtggggtgctgaactccctgggaaagatggtgcaccagatcttcgggagcgcctacaccgctctcttctccggcgtcagctggatcatgaaaattggcataggtgtgctgctcacgtggataggcctcaattctaagaataccagcatgagcttcagctgcatcgtgataggcatcatcaccctatacctaggcgccgtcgtgcaggcggacatggggtgcgtgattaactggaaaggcaaggagctcaagtgcggctccgggatcttcgttaccaacgaggtccacacgtggacggagcagtacaagttccaagccgacagccccaagcgactcgccactgccattgcgggcgcatgggagaacggggtgtgcggcatccgtagcaccacgcgcatggagaacctgctctggaagcagatcgccaatgagctgaactacatactgtgggagaacaacataaaactcaccatcgtcgtgggagacgtgatcggcgtactcgagcaaggcaagcggaccttgacgccccagcccatggagctcaagtacagctggaagacgtggggaaaggccaagatcgtgaccgccgagacccagaactccagtttcataatcgacggccccaatacccccgagtgcccctccgctagccgcgcctggaacgtgtgggaggtcgaggactatgggttcggcgtgttcacgaccaacatatggctgaagctgcgagaaaagtacacccaactctgcgatcacaggctgatgagcgccgccgtgaaggacgagcgggctgtccacgcggatatgggctactggatagagtcccagaagaacgggtcctggaagctcgagaaggcctccctcattgaggtgaagacctgtacgtggcccaagagccacacgctgtggtcaaatggcgtgctggaaagcgatatgatcatcccgaagtcgctcgccgggcccataagccagcacaattaccggcccggctaccacacccagaccgccgggccgtggcacctgggcaaactggagctcgacttcaactactgcgaaggcaccacggtcgtgattaccgagaactgcggtatcagaggcccctcactgcgcaccaccacggtgagcggcaagctgatccacgagtggtgctgccggagttgcaccctgccacccctgcgctacatgggcgaggatgggtgctggtacggcatggagatccggcctatcaacgaaaaggaggagaatatggtcaagagcttggtgtccgccggcagcggcaagaccgacaacttcacaatgggtgtgttgtgccttgcgatcctgttcgaagaggtcatgcgcgggaagtttggcaagaagcatatgatcgcgggggccctctttacgttcgtgttactgttatccgggcagatcacctggcgagacatggctcacaccctgataatgatcggcagcaatgcctccgaccgcatggggatgggcgtgacctatctcgccctcatcgccacgttcaagatccaacccttcctcgccctggggtttttcctccggaagctgaccagccgcgagaacctgctcctgggcgtaggcctggccatggcgaccaccctccagttgccggaggacatcgagcagatggccaacgggattgccctgggcctcatggccctgaagctgatcactcaattcgagacctatcagctttggaccgccctcatcagcttgatgtgctccaacacaatctttacgctcaccgtggcgtggcggacggccaccctgatcctggccgtgatcagcctcttacccgtctgccagtcctcctccatgcgcaagacagactggctaccgatgactgttgccgccatgggggtgccgcccctccccctgttcatcttcagcctgaaagacaccttgaagcggaggtcctggccgctgaacgagggcgtcatggccgtaggtctggtcagcatcttagccagttcatttctgagaaacgatgtgcccatggccggccctctggtggctggagggctcctgatcgcctgctacgtcatcaccggcacgtccgcggacctgacagtggaaaaagccgccgacgtcacctgggaggaggaggccgaacagaccggggtcagccacaacctcatgatcacggtggacgacgacggcaccatgcggataaaggacgacgagaccgaaaacatcctgactgtgctgctcaaaactgccttactgatcgtctccgggatcttcccgtacagcatcccggccacgctcctggtgtggcatacctggcagaagcagacacagcgctccggcgttctgtgggacgtgccctccccacccgagacgcagaaggccgaactcgaggagggcgtttaccggatcaaacagcaggggatcttcggaaagacccaggtgggggtcggagtgcagaaggagggggtgttccacaccatgtggcacgtgacccgaggcgcagttctgacccacaacggcaagcggctggagccgaactgggccaacgtgaagaaggacctgatctcctacgggggcggatggaagctgagcgcccagtggcagaagggggaggaggtccaggtgatcgccgtggagccagggaagaacccgaagaacttccagacgatgcccggtatcttccagactaccactggcgaaatcggggccatcgccctggattttaagccgggcacgtccgggagccccatcatcaaccgcgagggcaaagtcgtgggactgtatgggaacggcgtagtgaccaaaaacggcggctacgtgagcgggatcgcccagaccaacgcggagccagacggcccgacgcctgagcttgaggaggagatgttcaagaagcggaatttgacgatcatggatctgcaccccggctcagggaaaacccgcaaatatctccccgcgatcgtacgggaggccatcaagcgccggctgcgcaccctaatcctcgctccgaccagagtcgtagccgcggagatggaggaggcgctgaaaggcctacccattcggtaccagacgaccgccaccaagagcgagcacaccggcagagaaatagtcgacctcatgtgccacgccacgttcaccatgcgcctgctgtcccctgtccgggtgcccaactataacctcatcgtgatggacgaagctcactttaccgatcctgcgagcatagcagcccgcggctacatctccacccgggttgggatgggcgaagcggcggccatcttcatgacggccacgcctcccggcacagccgacgccttcccccagagcaacgcgccaatccaggacgaggagcgcgacattccggagcggtcctggaactccgggaacgagtggatcaccgatttcgccggcaagactgtgtggtttgtgccctccatcaaggccggaaacgacatagccaactgcctccgaaagaacggtaagaaggtcatccagctgagtcgcaagaccttcgacaccgagtaccagaagaccaaactcaacgactgggacttcgtggtgacgaccgacatctccgagatgggcgccaacttcaaagcggatcgggtcatcgacccccgccggtgcctgaagccggtgatcctgaccgatggccctgagcgcgtgatcctcgccggacccatgccagtcaccgtggccagcgccgcgcaacggcgcgggagggtgggccgcaacagccaaaaggagaacgaccagtacatcttcacggggcagccgctgaacaacgacgaggaccacgcgcactggaccgaggccaagatgctgctcgataacatcaacacccccgagggcatcatcccagcgctgttcgagccggagagagagaagagtgccgccatcgacggcgagtaccgcctgaagggcgagtcccggaagaccttcgtggagctcatgcgcagaggtgacctgccggtgtggctggcccacaaagtggctagcgaagggatcaagtacaccgaccgcaaatggtgcttcgatggcgagcggaacaatcagatcctcgaggagaacatggacgtcgagatctggaccaaggagggtgagaaaaagaaacttcgcccccggtggttggacgcacgcacctactccgaccccctcgcccttaaagagttcaaggactttgcggccgggaggaaaagcatcgccctggacttggtgactgagatcggccgagtccccagccaccttgcgcaccgaacccggaacgccctggacaacctcgtgatgctgcacacgtcagagcacgggggacgcgcgtaccggcacgccgtggaggagctgcccgagaccatggagaccctcctgctgctagggctgatgatcctgctcaccggcggggctatgctgttcttgatcagcggtaaaggcatcgggaagacgtccataggtctcatctgcgtcgtggctagctccgggatgctgtggatggccgacgtccccctgcagtggattgcgagcgccatagtcctcgagttcttcatgatggtgctgctgatccccgagccggagaagcagcgcacgccccaggacaaccagttggcctacgtcgttatcggcatactgaccctggccgccatcgtggcggccaacgagatggggctgctggaaaccacgaagcgggacctgggcatgagcaaggagcctggcgtggtcagccctacctcctacctcgacgtggacctgcacccggcctcggcttggaccctgtacgcggtagccaccacggtcatcacccccatgctgagacataccatagaaaattccactgccaacgtgagcctggccgccatcgcgaaccaggcagtggtcctgatggggctcgacaagggctggcccatctccaagatggatctgggggtgccgctgctcgccctcgggtgctacagccaggtgaaccctctgacgctcaccgcggccgttttgctactcgtgacccactacgcgatcatcgggcccggcctgcaggctaaggccacacgggaggcccagaagaggacagccgcgggcattatgaagaacccgacagtggatgggatcatgaccatagatctagacccggtgatctatgactccaagttcgaaaagcagttgggccaggttatgctgcttgtgctctgcgccgtgcagttactgctcatgcggaccagctgggcgttctgcgaggccctgacgctagccaccggcccgatcaccaccctttgggagggctcccctggaaagttctggaacacgacaatcgccgtaagcatggccaacatcttccgggggagctatttagccggcgcagggctggcgttcagcatcatgaagagtgtgggcaccggaaagcggggcactggcagccagggtgagactttaggcgagaagtggaagaagaaactgaaccaactgagccgcaaggagttcgatctctataagaagtccgggatcaccgaggtcgaccggaccgaggcgaaggagggcctgaagaggggcgaaattactcaccatgctgtgagccgggggtccgccaagctccagtggttcgtggaacgcaacatggtgatccccgagggccgggtgatcgatctcgggtgcggccgcgggggctggtcttactactgcgccggtctgaaaaaggtaacagaggtgcgaggctacacgaagggagggcccggccacgaggagcccgttcccatgtccacctatgggtggaacatcgtgaagctgatgagcggcaaggacgtcttttaccttccgcccgaaaagtgcgacactttactgtgtgacattggggagagtagcccgtcccccaccgtggaagagagcaggacgatcagagtgctgaaaatggtcgaaccctggttgaagaacaatcaattctgcatcaaggtgctgaacccctatatgccgaccgtgatagagcaccttgagcgcctccagcgcaagcacggcggcatgctggtccggaaccccttatcccgcaacagcacccacgagatgtactggatctccaatgggaccggcaacatcgtgagttccgtgaacatggtcagccggctcctactgaaccgcttcactatgacccaccggcgccccaccatcgaaaaggacgtggacctcggggcgggcacccgacacgtgaacgccgaacccgagacgccgaatatggacgttatcggcgagcgcatccggcgcatcaaggaggagcactcctccacctggcactatgacgacgagaacccgtacaagacgtgggcttaccacgggtcctacgaagtgaaggccaccggctctgccagctccatgatcaacggggtcgtgaagctcctgacgaagccctgggacgtggtccctatggtgacccagatggccatgaccgacactacgccctttggccagcagcgggttttcaaggagaaggtcgacaccagaactccccggcccatgcctgggacccgcaaggtgatggagatcacggccgagtggctatggcggacgctgggcaggaacaagcggccccgcctctgcacccgggaagagttcatcaagaaggtgcgcacgaatgccgctatgggcgccgtctttacggaggagaatcagtgggactcggcccgcgccgccgtggaggacgaggagttctggaagctcgtggacagggagcgcgagctgcacaagctaggcaaatgcggctcctgcgtctacaacatgatggggaagcgggagaagaaactcggcgagttcgggaaggccaagggcagccgggccatctggtacatgtggctgggggctcggtatctggagttcgaggccctcgggttcctgaatgaggaccactggttctcccgcgagaactcgcactccggcgtcgaaggggagggcttacataagctcgggtacatcctgcgggacatcagcaaaatcccgggcggcgccatgtacgcagacgacaccgcggggtgggacacccgcatcaccgaggacgatctgcacaatgaggagaagatcacgcagcagatggatcccgagcatcgccagctagctaacgccatcttcaaactgacctaccagaacaaagtggtcaaggtgcagcgcccgaccccaaagggcaccgtgatggacatcatctccagaaaggaccaacgcgggagcggccaggtcggcacgtacggtctgaacactttcaccaacatggaagcccagttaatccggcaaatggagggagagggggtgttatccaaggccgacctggagaatccccacctcctggagaagaaagtgacccagtggctggaaacgaaaggcgtcgagcgcctcaagcggatggcaatcagcggggacgattgcgtggtgaagcccatagacgaccgcttcgccaacgccctgctagccttaaacgacatgggtaaggtccggaaggacatcccgcagtggcagccgtccaaaggctggcacgactggcagcaggtcccgttctgctcgcaccacttccacgagctgatcatgaaggacgggcggaagctggtggtaccatgtcggccgcaggacgagctcatcggacgcgcccgcatttcccaaggtgcgggctggagtctcagggaaacggcctgcctgggcaaggcctacgcccagatgtgggcgctcatgtacttccacaggcgggacctgcgcctggcctctaacgcgatctgcagcgctgtgcccgtgcactgggttcctacgtcccgtaccacctggagcatccacgcccaccaccagtggatgaccaccgaggacatgctcaccgtgtggaaccgcgtgtggattgaggataacccctggatggaggacaagaccccggtcacaacctgggaggacgtgccctacctgggcaagcgggaggatcagtggtgcggtagcctgatcgggttgacctcccgcgcgacatgggcacagaacatcctgaccgccatccagcaggtccggagcctcatcggcaacgaggagtttcttgactacatgccatccatgaagcgctttcgtaaggaggaggagagcgagggggcaatctggtga

SEQ ID NO: 26164 - RNA, 9873 nt, synthetic construct
  misc_feature 1..9873: note = derived and/or modified CDS sequence (opt11) from DENV-3__JQ920484__SS-prME
  source 1..9873: mol_type = other RNA
acctccctttgcctgatgatgatgctgcccgccaccttagctttccacctcaccagccgggacggtgagccacggatgattgtgggaaagaatgagcggggtaagagcctgctgttcaagacagcctcagggataaacatgtgcaccctcatcgccatggacctaggcgaaatgtgcgacgacaccgtgacctacaagtgcccactgatcacggaggtggagcctgaggacatcgactgctggtgtaacctcacgagcacttgggtgacctacgggacctgtaaccaagcgggcgagcaccggcgcgacaagcggtccgtggccctggcaccccatgtcggcatggggctggacacacgaacccagacctggatgagcgcggagggcgcctggcgccaagtcgagaaagtcgagacctgggccttccgccaccctgggttcaccatactcgctttgttcctcgcgcattacatcggcacctccctcacgcagaaagtggttatcttcatcctgttgatgctcgtcacgccctcgatgaccatgcggtgcgtgggggtgggcaaccgggacttcgtagagggcttgtccggggccacctgggtggacgtggtcctggaacacggtgggtgcgtaaccaccatggccaagaacaagcccacactcgacatcgagctacagaagaccgaggccacgcagctggccaccttgcggaaactgtgcatcgagggcaagatcactaacgtgacaacggactccaggtgccccacccagggggaggcgatcctgccggaagaacaggaccagaactacgtctgtaagcacacgtacgtggaccgggggtgggggaatggatgcggcctcttcgggaagggctccctggtgacctgcgccaaattccagtgcctggagagcatcgagggcaaagccgtccagcacgaaaacctcaagtacacggtgatcatcactgtgcacaccggggatcagcaccaggtcggcaacgagacccaaggggttacagccgagatcacaccccaggcctcaaccgtcgaggcaatcctgcccgagtacggcaccctggggctcgaatgtagcccccgaacgggactggacttcaacgagatgatcctgctcacgatgaagaacaaggcctggatggtgcaccggcagtggttcttcgaccttcctctaccctggacctccggcgccaccaccgagacccctacctggaacaaaaaggaactcctggtaaccttcaaaaacgcccacgccaagaaacaggaggttgtggtgctggggagccaagagggcgcgatgcacaccgcattaactggggccaccgaaatccagacttccggcggcacgagcatcttcgccggccacctcaagtgtcgcctaaagatggataagttggaactgaagggcatgagttacgccatgtgcctcaatgcgttcgtcctcaagaaggaggtgagcgaaactcagcatgggaccatacttatcaaggtggagtacaaaggcgaggacgccccctgtaagattcccttcagcaccgaggacggccagggcaaggcccataacggccggctgattaccgccaaccccatcgtcactaagaaagaggagccagtgaatatcgaggcggagccgccgttcggggaaagcaatatagtgatcggcatcggggacaaggccctgaaaatcaattggtacaagaagggcagcagcatcggtaaaatgttcgaggccaccgcccgcggtgcccgccgcatggcgatcctaggcgacaccgcatgggatttcggcagcgtcggcggggtgttaaactcgctgggcaagatggtgcaccaaatcttcgggagcgcctatacggccctcttctccggcgtctcttggatcatgaagatcggcatcggggtactgctgacgtggatcggcctcaattccaaaaacaccagcatgtctttcagctgcatagtgatcgggatcatcaccctgtacctgggtgcggttgtgcaagcggatatgggatgcgtcatcaactggaaggggaaggagctcaagtgcggctccgggatcttcgtcacaaatgaggtgcacacgtggactgagcagtacaagtttcaggccgatagccccaagcggctggccaccgctatcgccggggcctgggagaacggggtgtgcggcatccgctccaccacgcgcatggagaacctactctggaagcagatcgccaacgaacttaactatatcctgtgggaaaacaacataaaacttaccatcgtcgtgggggacgccatcggcgtgttagaacaggggaagcggacactgacgccccagcctatggagctcaagtactcatggaagacctgggggaaggcgaagatcgtcaccgcggaaacccagaacagcagtttcattatagacggccccaatacccccgagtgcccctcagcctcacgagcctggaacgtttgggaggtggaggactacggcttcggcgtcttcacgaccaacatctggctgaagctacgggaaaagtacacgcagctctgcgaccaccgtctgatgagcgccgccgtgaaggacgagcgggcggtgcacgcggatatgggctactggattgaatcgcaaaagaacgggagctggaagctagagaaagcctccctcatcgaggttaaaacatgcacctggcccaagtcacacacattgtggtccaacggggtgctagagtctgacatgatcataccgaagtccctcgctgggcccatctcacaacacaactaccggcccggctaccacacccagaccgccgggccgtggcacctgggaaaactggaactcgacttcaactattgtgagggaactactgtggtaataaccgagaactgcgggatccggggcccctccctaagaacgaccacggtttcggggaagctcattcatgagtggtgctgccggtcatgtaccctgccgcccctccgctacatgggcgaggacgggtgctggtacggcatggaaattcggccgatcaatgaaaaggaggagaatatggtgaaatcactggtcagtgcgggcagcggcaagaccgacaatttcacgatgggcgtgttatgcctggccatcctgttcgaggaggtgatgagaggcaagttcggcaagaagcacatgatagctggagccctcttcacgtttgtcctgctgctatccggccagatcacctggcgggacatggcgcacaccctgatcatgatagggagcaacgcgtccgaccgcatggggatgggcgtcacgtacttggccctcatcgccacgttcaagatccagcctttcctggccctggggttcttcctccggaagctgacaagccgcgagaacctgttactgggcgtgggcctagcgatggccaccactttgcagctgcccgaggacatcgagcagatggccaacgggatcgccctgggcctcatggccttaaaactgatcacacaatttgagacatatcagctctggacagcgttaatcagcctgatgtgctcgaacaccatcttcacattgaccgttgcctggcggaccgccaccctgatcttagccgtgatttctctcctccccgtgtgccagtccagctccatgcgcaaaaccgactggttacccatgaccgtcgccgcgatgggggtcccgcccttacccctgttcatcttcagcctgaaagacaccttaaagcggcgctcatggcctctaaacgagggtgtgatggccgtcggtctggtaagcatcctcgcctccagctttctgcgcaacgacgtccccatggccggccccctggtggccggcggtctgctgatcgcgtgctacgtgatcaccggcacatccgccgacttaaccgtcgagaaggccgccgacgtaacctgggaggaggaggccgaacagactggggtgagtcacaatttaatgatcacagtcgacgacgacggtacaatgcggatcaaggacgacgagaccgagaacatactgaccgtgctgctcaagaccgcgctgctgatcgtgtcgggaatctttccatacagtatcccggcaacactccttgtctggcatacctggcagaaacagacccagcgctcgggtgtgctatgggacgttcccagccctcccgagacccagaaggcagagcttgaggagggcgtctaccgcatcaagcagcagggcatcttcggcaagacccaggtgggggtgggcgttcagaaagagggggtgtttcacaccatgtggcacgtgacccgcggcgcggtcttgacctataacggcaagcggctggagccgaactgggcaaacgtgaagaaggacctcattagctacgggggcgggtggaagctgagcgcccagtggcagaagggagaggaagtgcaggtcatcgctgtagagcccgggaagaaccccaagaacttccagacgatgcccggcatcttccagaccacgaccggcgagatcggggctatcgccttagactttaaaccgggcacgtccgggagccccatcatcaaccgcgagggcaaggtggtgggcctgtacgggaacggcgtggtgaccaagaacgggggctacgtgtcagggatcgcacagaccaacgcggagcccgatggccctacccccgagctcgaagaggaaatgttcaagaagcgaaacctaacgatcatggacctacaccccggctccggtaagaccagaaagtacctccccgccatagttcgggaagccatcaaacgccggctgcgcaccctgatccttgcaccgacgcgggtggtcgcggcagagatggaggaggccctgaagggcctgcccatccgctaccagaccaccgccaccaagagcgagcacaccggtcgggagattgtggacttaatgtgccacgccaccttcaccatgcgcttgctgagccccgttcgggtcccgaattataacctgatcgtgatggacgaggctcacttcaccgacccggccagcattgccgcccgcggctacatctctacccgggtgggcatgggggaagcggccgcaatcttcatgacggccacgccgcccggcaccgccgatgcgttccctcagagcaacgccccgatccaggatgaagaacgcgatatcccagagaggtcctggaatagcggaaacgagtggatcaccgatttcgccggcaagacggtttggttcgtgccctctatcaaggccgggaatgacatcgccaactgcttgcgtaaaaacgggaagaaagttatccagctgagccggaagaccttcgacaccgagtaccagaagacaaagttaaacgactgggacttcgtcgtgacgacagatatctcggaaatgggggcgaactttaaggccgaccgggtgatcgaccctcggcggtgtctaaagccagtcatccttactgacggccccgagcgggtgatcctcgccggaccgatgcccgtgaccgtagcctcggccgcgcagagaagaggaagggtggggcggaactcacagaaggaaaatgaccagtacatcttcacggggcagccgctaaacaatgacgaggaccacgcgcactggaccgaagcgaagatgctgctggacaacataaacacccccgagggcatcatcccagctctgttcgagcccgagcgggagaagtccgcggccatcgacggggagtaccgcctgaagggcgagtcccggaagaccttcgtggaactaatgagaaggggcgacctgccggtctggctggcccacaaggtggccagcgaggggatcaagtacaccgaccgcaaatggtgcttcgacggcgagcgtaacaaccagattctcgaggagaacatggacgtggagatctggacgaaggagggagagaaaaagaagctgcgcccccggtggctggatgcccgcacgtattccgaccccctggcgctgaaggagtttaaagacttcgccgccggcagaaagtctatcgcattagacctcgtcaccgagattggccgggtgccctcacacctggcccaccgcacccggaacgcgttagacaacctcgtaatgctacatacgtcggagcacgggggacgcgcctaccgtcacgccgtggaggaactcccggagactatggaaactctcttgctgctcggcctcatgatcctgctcaccgggggcgccatgctattcctcatatccggcaaaggcataggaaagacgtccatcggcttgatctgcgtggtcgcaagctccggtatgctgtggatggcggacgtgccgctgcagtggatcgccagcgcgatcgtgctagagttctttatgatggtcctgcttatccccgagccggagaagcagaggacaccccaggacaaccaactcgcatacgttgtgatcggcatcctgactctggccgcgatcgtcgccgccaacgagatggggctcctggagaccacgaagcgagacctgggcatgagcaaggagcctggcgtggtgagcccgacctcatacctcgacgtggacctgcacccggccagcgcctggaccctctacgccgtggcaacaacggtgatcacacccatgctccggcacaccattgagaactcgaccgccaatgtcagcctggcagcgatcgccaaccaggccgtggtgctgatgggattagacaaaggctggcccatatccaagatggacctgggggttcccctgttagccctggggtgctacagtcaggtcaacccgttgacactcaccgccgcggtgttattgctcgtgacacactacgcgataatcgggcctggcctgcaggccaaggccacccgtgaagctcagaagcgcacggcggccggcatcatgaaaaaccccaccgtggacgggataatgaccatcgaccttgaccccgtgatctacgactccaagttcgaaaagcaacttgggcaggttatgctgttagtgctttgcgccgtccagctgctgctcatgcgcaccagctgggccttctgtgaggcgctgacgctcgcgacagggccaatcaccactctttgggagggctccccgggcaagttctggaacacgacgattgccgtcagcatggccaacatattccgggggtcctaccttgccggcgcggggctggccttcagcatcatgaaatccgtgggcaccgggaagcgtggcaccggcagccaaggagagaccctaggcgagaagtggaagaagaagttaaaccagctaagcaggaaggagttcgacctctataaaaagagcgggatcaccgaggtggacagaaccgaggccaaggagggcctgaagcgcggggaaatcacccaccacgcagttagccggggctccgccaagttgcagtggttcgtggagcgcaacatggtgatccccgagggccgggtcatcgacctcgggtgcggacgcggagggtggtcgtactactgcgcggggctgaaaaaggtgacagaggtgagaggctacaccaagggcgggcccggacatgaggagccggtcccgatgagcacttacggatggaacatcgtgaagctgatgtccggaaaggatgtattctacttaccacccgagaagtgcgataccctgctttgtgacatcggggagtccagcccgtccccgaccgtcgaagagtcccgcacgatccgggtgctcaagatggtggagccctggctcaagaataaccaattctgcatcaaggtcctgaacccctacatgccgaccgtgatagaacacctggagcgcctccagcgcaagcacggcggcatgcttgtgcggaaccccctgtcccgcaattcaacccacgagatgtactggatatccaacgggaccggtaacattgtcagctccgtgaatatggtttcacggctcctgctgaaccgcttcacgatgacccaccggaggcccaccatagagaaggacgtcgacctcggggctggcacccggcatgtgaacgctgagcccgagacgccgaacatggacgtgatcggcgagcggatacggcgcatcaaggaggagcacagcagcacctggcactacgacgatgagaacccctacaagacctgggcctaccacgggagttatgaggtcaaggccaccggcagcgcgagctccatgataaacggggtagtcaagctgttaacgaagccctgggacgtggtgccgatggtcacccagatggccatgaccgacaccacgcccttcgggcaacagcgggtattcaaagagaaggtggacactcgtacgccccgccccatgccggggactcgcaaggtcatggaaattacggcggagtggctctggcgaaccctgggccggaacaaacggcccagactgtgtacccgggaggagttcatcaagaaggtgcgcaccaacgcagcgatgggcgccgtgtttactgaagaaaatcagtgggactcagcccgcgccgccgttgaggacgaggagttctggaagctcgtggaccgggaacgcgagctgcataagctgggaaagtgcggctcctgcgtgtacaatatgatggggaaacgggagaaaaagctaggtgagttcgggaaggcgaaaggtagccgcgccatctggtatatgtggctgggggcacggtacttggagttcgaagcgctcgggtttctgaatgaggatcactggttctccagggagaacagccactccggcgtcgagggggaaggattacacaagctcggctacattctgcgggacatctctaagatccccggcggcgcgatgtatgcggacgacaccgccggatgggacacacgcattactgaagatgacctgcacaacgaggagaagataacacagcagatggatcctgagcatagacagctcgccaacgccatcttcaagctgacataccaaaataaggtggtgaaggtccagcgcccgacccctaagggcaccgtaatggacatcatctcccggaaagaccagcgcgggtcaggccaggtgggcacgtacgggcttaacactttcaccaatatggaggcccagctcatacggcaaatggagggggagggagtcctgtccaaagcggaccttgagaatccccatctcttggagaagaaggttacccagtggctggagaccaagggggtcgagcgcctcaagcgtatggccatcagcggcgacgactgcgtagtgaaaccaatcgacgaccgcttcgctaacgccctgctggcccttaacgacatggggaaagtgcggaaggatataccacagtggcagccgtccaagggctggcacgactggcagcaggtccctttttgcagccaccacttccacgagttaatcatgaaggacgggcgtaagctcgtggttccctgccggccccaggatgagctaattggtcgtgcgcgaatctcccagggtgccggctggagcctgcgcgagacggcatgcttggggaaagcctatgcgcagatgtgggccctcatgtacttccaccgccgcgatctacgcctggcaagtaatgccatctgcagcgccgtcccagtgcactgggtgcccaccagtcggacaacctggagtattcacgctcaccatcagtggatgacgacagaggacatgctaaccgtatggaaccgcgtgtggatcgaggacaacccctggatggaggacaagaccccggtgactacctgggaggacgtcccctatctcggcaagagggaggaccagtggtgcggctccctgatcgggctcacctcccgcgcgacctgggcccaaaacatcttgactgcaatccagcaggtccggtctctgatcggcaacgaagagttcctcgactatatgccctccatgaagcgcttccggaaggaggaggaaagcgagggggcaatctggtga

SEQ ID NO: 26165 - RNA, 9873 nt, synthetic construct
  misc_feature 1..9873: note = derived and/or modified CDS sequence (opt11) from DENV-3__JQ920486__SS-prME
  source 1..9873: mol_type = other RNA
accagcttatgtctcatgatgatgctgcccgccaccctggccttccatttaactagccgggacggcgagccccggatgatagttgggaagaacgagcggggcaagagtctcctgttcaagacagcctcggggattaatatgtgcacccttatcgctatggacctgggagagatgtgcgacgataccgtgacctacaagtgcccactgatcactgaggtggagcccgaggacatagactgctggtgcaatctcaccagcacatgggtgacgtacggtacctgcaaccaggccggtgaacaccggcgcgacaagagatccgtggcccttgcgccacacgtgggtatgggtctggacacccgaacccaaacctggatgagcgcggagggagcatggcgacaggtggagaaggtcgaaacatgggcgttccgccaccccgggttcaccatactcgcgctgttcctggctcactatatcggtacctccctaacgcaaaaggtggtgatcttcatcctgctcatgttagtcaccccaagcatgaccatgcgatgcgtgggagtgggcaaccgcgatttcgtcgagggcctatccggggccacctgggtggacgtagtcctggagcacggcggatgcgtaacgaccatggccaagaacaaacccaccctcgacatcgagctgcaaaagacagaagccacacagctggccaccctccggaagctatgcatagagggcaagatcactaacgttaccacggactccaggtgccccacacagggcgaggccatcctgccggaagaacaggaccagaactacgtctgtaagcacacctatgttgaccggggatggggcaatgggtgcggcctctttgggaagggctccctggtgacctgcgccaagttccaatgcctggagagcatcgagggcaaagccgtccagcacgagaacctcaaatacacggtgatcatcacggttcacaccggcgaccaacaccaggttggcaacgagacccagggggtcacggccgagatcacgccccaagcctccacggtcgaggcgatactgcccgagtacggcaccctgggcctcgagtgttctccccgaaccggcctggactttaatgaaatgatcctgctgacgatgaaaaacaaggcctggatggtgcaccgtcaatggttcttcgacctgccgctgccctggacctccggcgccaccaccgaaacgcccacttggaacaagaaggaattactggtgacctttaaaaatgcccacgccaagaagcaagaggtagtagtgctggggagccaggagggggcaatgcacaccgccctcacgggtgccaccgaaatccagacctccggagggaccagcatcttcgccggccacctgaagtgccgcctgaagatggacaagctcgagctgaaaggcatgtcctacgctatgtgcctgaacgcattcgtcctcaagaaagaggtgagtgagacgcagcacggtaccatcttgatcaaagttgagtacaagggcgaggatgcgccctgtaaaataccattctcgaccgaggacgggcagggcaaagcccacaatggccggctgattaccgctaaccccattgtcactaagaaggaggagcccgtgaacatagaagcggagccgcccttcggtgagtcaaacatagtgatcggtatcggggacaaagccctgaagataaactggtacaagaagggttcatccatagggaagatgttcgaggccaccgcccgcggggcgcggcgcatggccatcctcggcgacaccgcctgggacttcgggtcagtcggcggggtgttaaactcgctgggcaaaatggtgcaccagatcttcgggtctgcctataccgcactcttctccggcgtctcatggatcatgaagatcggcattggcgtgctgctgacgtggatcgggttaaactccaagaacacttcgatgtcgttcagctgtatcgtaatcggcattatcaccctgtacctgggcgccgtcgtgcaggcggacatggggtgcgtgatcaactggaagggcaaggagctcaaatgcggctcaggaatcttcgtcacgaacgaggtgcatacgtggactgagcagtacaagttccaagccgactctccaaagcggctggccacagccatcgccggcgcgtgggagaacggtgtgtgcggcatccgctcgaccacccgcatggagaacttactctggaagcaaatcgccaacgaattaaactacatcctgtgggagaacaacatcaaactcaccattgttgtgggggacgccataggcgtgctggaacagggcaagcggaccctgacgccccaacccatggagctcaagtatagctggaagacctgggggaaggccaaaatcgtcaccgcggagacgcagaactcctccttcattatcgacggtcccaacacgcccgagtgcccctccgccagccgcgcgtggaacgtgtgggaggttgaggattatgggttcggcgtcttcacgactaatatatggctgaagcttcgggagaagtatacacagctatgcgatcaccgcctgatgtcagccgccgtcaaggatgagcgggcggtgcacgtggatatgggatactggatagagtcccaaaagaacgggagctggaaactggagaaggcctctctgatcgaggtgaaaacttgtacgtggcccaagtctcacacgttgtggtctaacggcgtgctggagtcggacatgatcatcccgaagtccctcgcagggcccattagtcagcacaactaccgtcccggctaccacacccagacagcggggccgtggcacctgggcaagctggagctcgacttcaactattgtgagggcaccacggtcgttatcaccgagaactgcggtatccggggcccgtccctgcgcaccacaacggtaagcgggaaactgatccacgagtggtgctgccgatcctgcactttgccgcccctccgctacatgggtgaggacggatgctggtacggcatggagatccgaccgatcaacgagaaggaggagaatatggtcaagagtctggtgtcagcagggagcggaaagaccgataacttcaccatgggcgtactttgccttgcgatcctgttcgaggaggtcatgagagggaagttcggcaagaagcacatgatcgccggggctttattcacgttcgtgctgcttctatccggacaaatcacatggcgggacatggcccacaccctgatcatgataggttcgaacgcctccgacagaatggggatgggcgtgacctacttggcgctcatcgctacgttcaagatccagccctttttagccctggggttctttctccgtaagctaaccagccgcgagaatctcctcttaggcgttgggctggccatggcaacaactctccagctcccggaagacatcgagcagatggccaacggtatcgccctaggcctcatggccctaaagctgatcacgcagtttgagacataccagttgtggaccgcgctgatcagcctgatgtgctccaacaccatcttcacgctcaccgtagcgtggcggaccgccaccctgatcctagccgttatctcgcttttgcccgtctgccagtcctcctccatgagaaagacggattggcttccaatgactgtggcggccatgggagtgccgccactccccctgttcatctttagcctgaaggataccctcaagaggcgctcctggccgctgaacgagggtgttatggccgtggggctggtcagcatcctcgcctccagcttcctaagaaacgacgtgcccatggccggaccgctggtggccggcgggctgctgatcgcctgctacgtcatcaccggcacttccgcggacctcacggtagagaaagccgcagacgtcacgtgggaggaggaggccgagcagaccggggtcagtcacaacttgatgatcacggttgatgacgacggcaccatgcgtatcaaggacgacgagaccgagaacatcctcaccgtgctgctcaagaccgccctgcttatcgtctctgggatattcccctacagcattccggcaactttgctggtgtggcacacatggcagaagcagacccagcgctccggcgtgctctgggacgtccccagccctcccgagacccagaaggctgagctcgaggagggcgtttaccggatcaagcagcagggcatattcggcaagacccaggtgggggtcggcgtgcagaaggaaggtgtgtttcacaccatgtggcacgtgacccgcggcgccgtactgacccacaacggcaaacggctggagccgaactgggccaacgtgaagaaggatctcatctcatacggtggcgggtggaagctaagcgcgcaatggcagaagggcgaggaggtccaggtgatagccgtggagccggggaaaaaccccaaaaatttccaaacgatgcccggtatcttccaaaccaccacaggagaaatcggagccatcgccctggacttcaagccgggtacgtcaggcagccccatcatcaaccgcgagggcaaagtcgtgggcctgtacgggaacggcgtggtcacaaagaacgggggctacgtgagcggaattgcacagacgaacgcggagcccgatggaccaacccccgagctagaggaggagatgtttaaaaagcggaacctcacgatcatggacctacacccaggctccgggaaaacccgcaagtacctccccgccatagtcagagaagccataaagcgtagactacgcaccctgatcctcgccccgaccagagtcgtggccgcggaaatggaggaggccctgaagggactgccaatcagatatcagacgacagcaaccaagagcgagcacactggtagagagatcgtggatttaatgtgtcacgccacgttcaccatgcgcctgctttcaccagtccgcgtgcccaactacaacctcatcgtgatggatgaggcacactttaccgatccggcgagcatcgccgcccgcggctatatctccacacgggtcgggatgggcgaggccgcggccatctttatgaccgctacgccgccgggcaccgccgacgccttcccccagagcaacgcgccgatccaggatgaggagcgcgacatccccgaacggtcctggaattcgggtaacgagtggatcaccgacttcgccggcaagacggtgtggttcgtcccctccatcaaggcggggaatgatatcgctaactgcctgcgcaagaacggcaaaaaagtaatccagctgagccgcaagacattcgacactgagtaccaaaaaaccaagttgaacgactgggacttcgtggtgacgaccgatatcagtgagatgggggccaacttcaaggccgatagagtgatcgacccccgccggtgcctgaagcccgtgatcctgacggacggtcctgagagggtaatcctcgccggccccatgcccgttaccgtggcaagcgccgcccagcggcgagggagagtcggccgtaactcgcaaaaagagaacgaccagtacatattcacgggccagccgctgaacaacgatgaggatcacgcgcactggaccgaggccaagatgttattagataacatcaacaccccggagggcatcatccccgccctcttcgagccagaacgtgagaagtcagccgcgattgacggggagtaccgcctgaagggggagtcccggaagaccttcgtcgagctcatgcgccggggcgatctgcccgtgtggctcgcccacaaggtggctagcgagggtatcaagtataccgaccgcaagtggtgcttcgacggtgagcggaacaaccagatcctcgaggagaacatggacgtcgaaatctggacgaaggaaggggagaagaagaaactacgtccacggtggctggacgcaagaacatactcagaccccctcgccttgaaggagttcaaggacttcgcggctggccgaaagagcatagctctggacctggttactgagatcggcagagtgccctcccacctggcccaccgcaccaggaacgccctggacaacctcgtgatgctgcacacgagcgagcacggcggccgcgcgtatcggcacgccgtagaggagttgccggagaccatggagacactcctgctgcttgggctgatgatcctcctcaccggcggggccatgctgttcctgatcagcggaaagggcatcgggaagacctccatcggcttgatctgcgtggtggcaagctccggtatgctgtggatggccgacgtccccctacagtggatcgcgtcagccattgtcctcgaattcttcatgatggtgctgttaattcccgagcctgagaagcagcgcacgccacaggacaaccaactcgcctacgtggtcatcggcatcctgaccttggccgccatcgtggcggccaatgagatggggctcctagagacaaccaagcgggatctgggcatgtccaaggagcctggggtggtgagccccacttcatacctggatgttgatctgcatccggccagcgcctggaccttgtacgcggtggctacgactgtcatcacccccatgttacgccacaccatcgagaacagcaccgcgaatgttagcctggcagccatcgccaaccaggccgtggtgctgatggggctcgacaaaggctggccgatctccaagatggaccttggggtgccccttttagccctgggctgctacagccaggtcaaccccctgaccctcaccgctgcagttctgttactggtgacacattatgcgatcataggcccggggctgcaggccaaggccacccgggaggcccagaagcgtacagccgcgggaatcatgaagaaccccaccgttgacgggatcatgaccatagacctggaccccgtcatctacgactcgaagttcgagaagcagcttggccaggtaatgctgttagtgctctgcgccgtccagctgctgctaatgcgaaccagttgggcgttctgcgaggccctaacgctggcgaccgggccgatcaccaccctctgggagggctcccccggcaagttctggaatacgaccatcgctgtcagcatggccaacatcttccgcgggtcctacctggccggggccgggctggcgtttagcatcatgaagtccgtgggcaccggtaagcggggaacaggcagtcagggggagacgctcggcgagaagtggaagaaaaagctgaaccagctaagccggaaagagttcgatctctacaagaagtccggtataacagaggtagaccgcatcgaagctaaggagggcctgaaacggggagagatcacccatcacgctgtgagccggggctccgccaagctgcagtggttcgtcgagcgaaacatggtcattcccgaaggccgggtaatagacctcgggtgcggtcgcgggggctggagctactactgtgccggtctgaagaaggttaccgaggttcggggctataccaagggtggtcccggccacgaggagcctgtgcccatgtccacttacgggtggaacatcgtgaaattaatgtctggcaaagacgtcttctacctgccgcccgagaagtgtgacactttactgtgcgacataggggagtcctcaccgtctcccaccgtggaggagagccgcaccatacgggtactaaagatggtggagccctggctgaagaacaaccagttctgcataaaggtgttgaacccttacatgccgacggtgatcgagcacctggagcgcctccagcgcaaacacggcggcatgttagtgcggaaccccctgtcccgaaacagcacgcacgagatgtattggatctccaacgggaccggcaacatcgtgagtagtgtgaacatggtatcccggctgctgcttaatcgcttcaccatgacgcacaggcgccccactatcgaaaaggacgtcgatctcggggccgggacccggcacgtcaacgccgaacccgagacgccgaacatggacgtcatcggcgagagaatcagacgcatcaaggaggagcactcctcaacgtggcactacgacgacgagaatccgtataagacctgggcgtatcacgggtcctacgaggtcaaggccaccggcagcgccagctccatgattaacggggtcgttaagctcctaactaaaccgtgggacgtggtcccgatggttacgcagatggcaatgaccgataccactcccttcggccagcagcgtgtgtttaaagagaaggtcgatacgcgcactcctcgtcccatgcccggaacccgcaaggtcatggaaatcacagccgagtggctatggaggaccctgggccgcaataagcggcccaggctgtgcacccgggaggagtttatcaagaaggtgcgcaccaacgccgctatgggcgcggtcttcacggaggaaaaccaatgggacagcgcccgcgccgccgtggaggacgaggagttctggaagttggtggaccgggagcgcgagctccataagctggggaagtgcggctcctgtgtgtataatatgatggggaagcgcgaaaagaagctcggcgaatttgggaaggccaagggcagtcgcgccatttggtacatgtggcttggcgcccggtacctggagttcgaggccctaggcttcctgaacgaagaccactggttctcccgcgaaaacagccactccggcgtagaaggggagggattacacaaactagggtacatactgcgcgacatcagcaaaatacccgggggcgcgatgtacgccgacgatacggcggggtgggacacccgcataaccgaggacgacttacacaacgaagagaagatcacccagcagatggaccccgagcaccgccagttagccaacgcaattttcaagctcacgtaccaaaacaaggtggtcaaggtgcaacgcccgaccccgaaggggaccgtgatggatatcatctcccggaaggatcagcgcgggagtggccaggtcggcacctacgggctgaacacgttcaccaacatggaagcccagctgatcaggcaaatggagggcgagggggtgctgtccaaggccgacttagaaaaccctcacctcttagaaaaaaaggttacccagtggctggaaaccaagggcgtcgaacgcctcaagcggatggccatctcaggggacgactgtgtggtgaagcccatagacgacagattcgccaatgccctgctggccctcaacgatatgggcaaggtccgtaaggacattccccagtggcagccctccaaaggctggcacgactggcagcaggtgcccttttgcagccaccattttcatgagctgattatgaaggacgggcgcaagctggtggtcccctgtcggccccaagacgaattaatcggccgcgcgcggatctcccagggggctggctggagcctacgcgagacagcctgcctggggaaagcctatgcacaaatgtgggcgctcatgtacttccaccgccgggacctgcgcttagcctccaacgccatctgcagcgccgtccccgtgcactgggtgcccacatcccggaccacctggagcatccatgcccaccaccagtggatgaccaccgaggacatgttaaccgtgtggaaccgcgtgtggatcgaggacaatccctggatggaggacaaaacccccgtcaccacctgggaggacgtgccctacctgggcaagcgggaggatcaatggtgcggctccttgatcggcctcacctcccgcgcgacctgggcccagaacatcctgaccgccatccagcaggtacgctcccttatcggcaacgaggagttcctcgactacatgccgagtatgaagcgcttccggaaggaggaggagagcgagggagctatatggtaa

SEQ ID NO: 26166 - RNA, 9873 nt, synthetic construct
  misc_feature 1..9873: note = derived and/or modified CDS sequence (opt11) from DENV-3__JQ920485__SS-prME
  source 1..9873: mol_type = other RNA
acctccctctgcttaatgatgatgttgcccgcaacactagcctttcatctgacctcccgagacggcgagccccgaatgatcgtcgggaaaaacgagagagggaagtcgctcctttttaagaccgcgtcagggataaacatgtgcacgttgattgccatggacctcggcgagatgtgcgacgacactgttacctacaaatgtcccttgattacggaagtcgaacccgaggacatagactgctggtgcaatctaacgagcacatgggtgacctatggcacatgtaaccaggcgggagagcacaggcgcgacaaacgatctgtcgcactcgcaccacacgtggggatgggattggacacgcgcacgcagacatggatgagtgcagaaggagcatggcgtcaagtagagaaggtcgaaacgtgggcattccgacacccaggtttcacaatactagccctcttcctggcacactatataggtaccagcctcacccagaaagtagtgattttcatcctgctgatgctcgtcaccccaagcatgactatgcggtgcgtcggcgtagggaaccgagacttcgtagaaggacttagcggtgcaacatgggttgacgtcgtactagaacatggcggctgcgtcacgaccatggccaaaaacaaacccaccctagacatagaactgcaaaagacggaagcaacccaattagctacgctacggaaactgtgtattgagggtaaaatcacaaacatcactaccgactctagatgtcctacccagggcgaagcaatcttaccagaggaacaggaccaaaattacgtctgcaaacatacttacgtcgacagaggttggggcaatgggtgtggactcttcgggaaggggtcacttgtaacatgtgcaaagttccaatgtttggaatctatagaagggaaggcagtacagcatgagaacctgaaatacaccgtcatcataacggtccacacaggcgatcaacatcaagtcgggaacgaaacgcaaggcgtaaccgctgaaataacgccccaagccagtaccgtagaagcaatcttgcctgaatatggcacactaggattagaatgtagcccacgtacagggttagacttcaacgaaatgatattgctaacaatgaagaataaagcctggatggtacaccgacaatggtttttcgacctacccctcccctggacctcgggcgcgaccaccgaaaccccgacatggaacaagaaagaactactggttacattcaaaaacgcccacgcaaagaagcaggaagtagtagttctagggagtcaagaaggagcgatgcacacagctttaacaggcgctacagaaattcaaaccagcggtggaacgagcatattcgctgggcacctcaagtgcaggcttaagatggacaagcttgaactaaaaggcatgtcctacgccatgtgcctcaacgcttttgttctcaaaaaagaggtgtcagagacacaacacgggactattctgatcaaagtcgaatacaagggcgaggacgccccatgcaaaataccattctccacagaagatggccagggcaaggcccacaacgggcgactcatcacggcgaatcccatagttacaaagaaggaagaacccgtgaacatagaagctgaaccacccttcggagaaagcaatatcgtaataggcataggcgacaaagcactgaagataaactggtataagaagggttctagcattggcaaaatgttcgaagctactgcacgcggcgcgcgccgaatggcaatactaggagacacagcatgggacttcggaagtgtcggaggggtactcaacagtctcggaaaaatggtccaccagatattcggatccgcatataccgcactgttcagcggtgtcagctggataatgaaaatagggataggtgtactcctgacgtggatagggctaaactcgaagaacaccagtatgtcgttctcctgcatcgtcatcgggataataaccctatacctaggcgcagtagtacaagccgacatgggctgcgttatcaactggaaaggcaaggagttgaaatgcggctcgggaatcttcgttactaatgaggtacacacgtggaccgaacaatacaagttccaagcagactccccgaaacgtctagctacagccatagcaggggcgtgggagaacggcgtgtgcggtatacgatccacaacacgcatggagaacctactctggaagcaaatagcgaatgaactaaactacatattatgggagaacaacataaaactaactatcgtcgtaggcgatgtgataggggtgctcgagcagggaaagcggacacttactccccagcccatggaactgaaatacagctggaagacatggggaaaggccaaaatcgtgacggcggagacgcaaaactccagcttcatcatagacggccccaacaccccagaatgcccgtcagcgtcccgagcgtggaacgtatgggaggtggaagactatggattcggcgttttcaccacgaacatatggctaaaattgcgagaaaaacacactcagctgtgcgatcaccgcctgatgagcgcagccgtcaaggacgaaagagcagttcacgcagacatgggttactggatagaatctcagaaaaacggaagctggaaactagaaaaagccagccttatagaagtcaaaacgtgcacatggcccaagagtcacaccctatggagcaacggggtgctagaatcggacatgataatcccaaaaagtctagcaggcccgataagccagcacaactaccgaccgggttaccacacacagacggcaggaccatggcatctaggaaagctagagctagacttcaactactgcgagggcactacagtagtgattacggaaaactgtggcatcaggggcccatccctacgcacaacaaccgtcagtggcaaacttatccacgagtggtgttgccgaagttgcacgctaccccctttacgctacatgggggaagatggatgctggtacgggatggaaatcagaccaatcaatgaaaaagaggaaaacatggtcaaaagcctcgtgagtgccggatccggaaaaacagataacttcactatgggcgttctgtgcctggcaattctgttcgaagaagtgatgcgcgggaaatttggtaagaaacatatgattgcaggcgcactgttcacgttcgtactactactaagcggtcagattacatggcgggacatggcacacacgcttataatgataggcagcaacgcctccgaccgcatgggaatgggggttacgtacttagccctaattgccacgtttaagatacaaccctttctagcactcggtttctttttgcggaagctgacctccagagagaacctgctcctaggggtagggctagcgatggctaccactctacaactaccagaggacatcgagcagatggctaacggtatagcgctcggccttatggcactgaagttaatcactcaatttgaaacgtatcagttatggactgcattaataagtctgatgtgctcaaatacgatattcacactcactgttgcctggcggaccgcaacgctaattctagctgtaatatcattacttccggtatgtcagagcagcagcatgcgcaaaaccgactggctccccatgaccgtggcggcgatgggcgtcccgccgctcccattattcatcttctccctcaaggacacattgaaacggcgatcgtggcccctaaacgagggtgttatggcggttggactcgtaagcatccttgcatcaagtttcctgagaaacgatgtccccatggccgggccactggtcgcagggggcctcttgattgcgtgctacgttataacagggacgtcagctgacctcaccgtcgaaaaggcggcggacgttacgtgggaggaagaagctgaacaaacaggcgtgagccacaacctaatgatcaccgtggacgatgacggcacaatgagaataaaggacgacgaaacagaaaacatactaaccgtattacttaagacggccctgctcatagtctctggcatattcccatatagtatacctgcgactcttctcgtttggcacacctggcaaaagcaaacccaaaggtcaggagtcctgtgggacgtcccctcaccaccagaaacgcaaaaggcggagctcgaagaaggtgtctacagaattaagcaacaaggaatcttcgggaagacacaggtaggcgtgggggtccaaaaagaaggagtattccacactatgtggcacgtaactcggggggcagttcttacacacaacgggaaacggctagaaccgaactgggcaaatgtgaaaaaagatctaataagctacggcggcgggtggaaattaagcgcacaatggcaaaaaggggaagaagtacaggtgatcgccgtggaaccaggaaagaacccgaaaaactttcaaacgatgcccggcatcttccaaaccacaacgggcgagattggggccattgcccttgactttaaaccaggtacatccgggtcccctatcatcaaccgcgaaggtaaggttgttggcctctacggaaacggggtagtgacaaagaatgggggttatgtctccggcatagcccagacaaacgccgagccggacggcccgatcccggagctcgaagaggaaatgttcaagaaacgcaacctcacgatcatggacttacaccccggctccggaaagacgcgcaaatacttacctgctatagtgcgggaggcgataaaacggagacttcgaaccctgattctagcccccacgagagtggtcgcagcagagatggaagaagccctaaagggtctgcccatacggtaccagactacagccactaaatccgaacataccggacgagagatcgtagacctaatgtgccacgcaacgttcacgatgcgcctattgagcccggtccgagtccccaattacaatctaatagtaatggacgaggcacacttcaccgatccagcctcaatcgccgcccgaggttacatctccacgcgtgtagggatgggcgaggccgcagcaatattcatgaccgcgacaccacccggaaccgccgacgccttcccacagagcaacgccccgatacaagacgaggaacgagatatcccagaacggtcatggaacagcggaaatgaatggattacggacttcgcggggaaaacggtctggttcgtcccgagcatcaaggcgggaaacgacatagcaaactgcttaaggaaaaacggcaaaaaggtaatccagctgagcagaaagacattcgatacggagtaccaaaaaacgaaactcaacgattgggatttcgttgtaaccactgatatcagcgaaatgggcgcaaacttcaaagccgacagggtaatcgacccccgcagatgcttgaaacccgtaatattaaccgacggcccagaacgcgtcatactcgccggacctatgcccgtcaccgttgctagcgcggcgcaacgccgcggccgtgtgggacgcaacagccaaaaggagaatgatcagtacatattcacgggtcaacccctaaataacgacgaagaccacgcacattggacagaagcaaagatgctgctggacaacatcaacaccccggagggaattataccagccctattcgagcccgagcgagagaaaagcgcagcaatcgacggggaataccgcctgaagggagaaagcaggaaaacttttgtcgagctaatgcgacgcggagatctaccggtgtggctagcacacaaggttgcctcagaaggtattaaatatacggaccgcaaatggtgctttgacggagagcgcaataaccaaatattggaggagaacatggacgtcgagatatggacaaaagagggcgagaaaaagaaactgcgaccccggtggctagatgcacgcacatactcggacccccttgcactaaaagaattcaaggatttcgccgcaggacgcaagagcatagcgctagacctagtcaccgaaatcggtagggtaccatcccacctagcccacagaactcgcaacgcgttagataatcttgtcatgttgcacacgagcgaacacgggggtcgggcctaccgacacgcggtagaagagcttccagagactatggagacgttactcttactaggattgatgattctacttactggtggagcgatgctgtttctaatctcaggaaaagggattggcaagacgagtatcggccttatctgcgtggtagcttcaagcggcatgttatggatggccgatgtcccgctccagtggatagcctcagccatagtcctagagttcttcatgatggtgctcctaattcccgagcccgaaaaacagaggacaccgcaagacaaccagctcgcatacgtagtaataggcatcctgacactagcagccatcgtcgctgctaacgaaatggggctcttagaaacaacaaagcgagacttgggaatgtccaaagagccgggtgtagtcagcccaacgagctacctggacgttgacctacatcccgcgagtgcatggacgctttacgctgtagccacaacagtaataacaccaatgctccgacacaccatcgaaaacagcacagccaacgtgagcctcgcagcaattgcgaaccaggcggtcgtcttaatgggacttgacaaaggctggcccatatccaagatggacctaggcgttccgctactagctcttggatgctattcccaagtcaacccactgacactcaccgcagcggtccttctactcgtaacacactacgccattatagggccgggtctacaagcgaaagctacaagagaggcccaaaagcgaacggcagccgggataatgaaaaaccctactgtcgatggaatcatgacgattgacttggatcccgttatctacgatagtaagttcgaaaaacagctaggtcaggtcatgctgctcgtactctgcgcggtacaactactactcatgcgaacaagctgggcgttctgcgaagcactcacacttgccacgggcccgataacgacactttgggaaggctcaccgggtaagttctggaacacaaccatagcagtcagcatggcaaacatcttcaggggaagctacctagcaggggcagggctggctttcagcatcatgaaatccgtaggcaccgggaaacgcggaaccggctcacagggagagaccctaggcgaaaaatggaagaaaaagttgaaccagctaagcagaaaagaattcgatctttacaagaagtccggcatcacggaggtcgaccgcatcgaggccaaagagggactgaagaggggagagatcacccaccacgctgtgtccagaggctcggctaagttgcaatggttcgtggagcgaaacatggtaatcccggaagggcgagtaatcgacctggggtgcggaagggggggatggtcctattattgcgcgggcctaaagaaggtaaccgaagtaagagggtatacaaaaggaggcccaggtcacgaagaacccgtacccatgagcacatatggctggaatatcgtcaaactcatgagtggcaaagacgtcttctatctaccaccagaaaaatgcgatacactgctatgcgacataggcgaaagcagtccatcgccgacggtggaagagagccgcacaatcagggtactaaagatggtagagccctggctcaaaaacaaccaattctgcatcaaggtactgaacccatacatgcccaccgtgattgagcacctggaaaggcttcagcgcaaacacggaggaatgctcgtaaggaaccccttaagtaggaacagcacccacgaaatgtattggatcagcaacgggaccgggaacatagtctcaagcgtcaatatggtgtcgcgactactactcaaccgattcactatgacccatcgtcgcccaaccatcgagaaggacgtagacctgggagcaggaacccgccacgtaaacgcagaaccagaaaccccaaacatgaacgtgatcggcgaaagaatcaggaggatcaaagaagagcactcctccacgtggcattacgacgacgaaaacccatacaaaacgtgggcctaccacggatcatatgaagttaaagccaccggatcagcgtcatccatgataaacggggtagtgaagctgctcacgaaaccatgggacgtggtgcctatggtcacccagatggccatgaccgacaccaccccattcggccagcagagggtattcaaggaaaaagtggacacacgcacaccaagaccaatgccagggacgcgcaaagtcatggaaatcacggctgagtggctatggagaacgctggggcgaaacaagcggccacgcctatgcaccagagaggagttcataaagaaagtccgcaccaacgcagcaatgggagcagtatttacggaggagaatcaatgggatagcgcacgggcagcagtagaggatgaggaattttggaagctcgtagaccgcgaacgggaattacacaaactgggaaagtgtggatcgtgcgtctataacatgatgggcaagcgcgagaaaaaattaggtgagttcggcaaggcaaaaggaagcagagcaatatggtacatgtggttgggagcccgatatctagagttcgaagccctaggtttcctcaacgaagaccattggttttcccgggaaaacagtcactcgggagtagagggtgaaggcctccataaactaggctacattctgcgcgacataagcaagatccccggcggcgcaatgtacgctgacgacacggccggctgggacacacggataacggaagacgacctgcacaatgaagaaaaaattacacagcaaatggacccagaacatcgacaattagccaacgcaatctttaaattgacctaccagaacaaggtcgtaaaagtccaaaggcccacgccaaaaggaacagtcatggacatcatcagccggaaggaccaaagaggttcaggccaagtcggcacatacggcttaaacacattcacaaacatggaggcccaattgatcaggcagatggagggcgagggagtactgtccaaagcggatctggaaaacccccatctcttggagaaaaaggtaacgcaatggctcgaaactaaaggagtggaacggctaaaacgaatggcaatcagtggggacgactgtgtcgttaaacccattgatgaccgattcgctaacgcacttctcgccctaaatgacatgggaaaggttcgcaaggacataccgcagtggcaaccttcaaagggatggcacgactggcaacaagttcccttctgcagtcaccacttccacgaattaataatgaaagacggccgcaaacttgtggtcccgtgcaggccccaagatgaactgataggccgagcgcgtattagtcaaggggcagggtggtcgctgagggagaccgcctgcctgggcaaagcgtacgcacaaatgtgggctctaatgtactttcacagaagggacctacgccttgcctctaacgcaatttgctccgcggtcccggtccactgggttccgacaagtcggactacctggagcatccacgcacaccaccaatggatgacaacagaagacatgctcacagtatggaatcgcgtgtggattgaagacaatccatggatggaagacaaaaccccagtgacgacatgggaggacgttccctatctgggaaaacgggaagaccaatggtgcgggtctctaatagggttgacatcaagggccacgtgggcgcaaaatatactaaccgccatacaacaagtaagaagccttatcggcaacgaagagttcctcgactacatgccatcaatgaagcgctttcgaaaggaagaggaaccagagggcgcgatatggtag

SEQ ID NO: 26167 - RNA, 9873 nt, synthetic construct
  misc_feature 1..9873: note = derived and/or modified CDS sequence (opt11) from DENV-3__FJ644564__SS-prME
  source 1..9873: mol_type = other RNA
acctcgctgtgcctcatgatgatactgcccgccgccctggcgttccacctcacgagccgtgacggagaaccccgaatgatcgttgggaagaacgagcggggtaaaagcctgctttttaagacggccagcgggattaacatgtgcacccttatagcgatggatctcggggagatgtgcgacgacaccgtgacctacaagtgtccacacattaccgaagtggagcccgaggacatcgactgctggtgcaatctcacctcgacctgggtaacctacgggacgtgcaaccaggccggcgagcaccggcgcgacaagcgatccgtagccctcgcgccacatgtgggcatggggttggatacccgcacccaaacctggatgagcgccgagggtgcatggcggcaagtcgagaaggtggaaacgtgggctctgcgccacccggggttcaccatcctcgctctattcctggcccactacatcggcacctcgcttacccagaaggtggtgatttttatcctgctgatgctcgtgacgccctccatgaccatgcggtgcgtgggtgttggcaatcgcgactttgtcgaggggctttccggggccacctgggtggacgtggtcctggagcacggcgggtgcgtcaccaccatggccaaaaacaaacccaccctagatatcgagctgcaaaagaccgaggccacccagctggcgacgctacgaaagttatgtatcgagggcaaaatcaccaatataacgaccgactcccgctgccccacgcaaggcgaagccgtgttaccggaggaacaggatcagaactatgtctgcaagcacacctatgtagataggggctggggaaacgggtgcggcctcttcgggaaagggagtctggttacctgcgcgaagtttcagtgtctggagcccatcgaaggcaaggtggtgcagtacgagaacttaaaatacacggtgattattaccgtccacaccggggatcagcaccaggtgggcaacgagacgcagggggtcaccgccgaaatcaccccccaggcaagcaccaccgaggccatccttcccgagtacgggacattggggctcgaatgctccccgcgaaccggcctggacttcaacgagatgatcctgctcacgatgaaaaacaaggcctggatggttcaccggcagtggttcttcgacctacccctcccctggacctcaggggccaccaccgagaccccgacctggaaccgcaaagaactgctggtgaccttcaagaacgcccacgccaagaaacaggaagtggtggttttagggtcccaggaaggtgcgatgcatactgctttgacgggggccaccgagattcagaacagcggcgggacgtccatcttcgccggccacttgaaatgccggttaaagatggacaagttagaactaaaaggtatgtcctacgccatgtgtaccaacacttttgtgctgaaaaaggaggtttccgagacccagcacgggacgattttgatcaaagtggagtacaagggcgaagacgcgccgtgcaagatcccattcagcaccgaggacggacagggcaaggcccacaatggccgcctgatcacggccaacccggtggtgacaaagaaggaggagcccgtaaacattgaggccgagccgcccttcggggagtcgaatatcgtcatcggcatcggggacaacgcgctaaagatcaactggtacaagaagggctccagcatcggtaagatgttcgaggccaccgcccggggcgcaagacgaatggctatcttgggcgacaccgcgtgggacttcggatcagtcggtggcgtgctcaattcactcggcaagatggtccaccagatcttcggttccgcttacacggccctgttctcgggcgtttcctgggtgatgaagatcggcattggggtacttctgacgtggattggtctgaacagcaagaatacttccatgagcttctcttgcattgccatcgggataatcaccctgtacctgggtgccgtggtgcaggcagacatggggtgcgttatcaactggaagggtaaagaactgaagtgcgggtccgggatcttcgtaacgaacgaggtgcacacctggaccgaacagtacaaatttcaagccgattccccgaagcgcctcgccaccgccatcgccggagcatgggagaacggtgtctgtggcattcgcagcaccactcggatggagaatctgctctggaaacaaatcgccaatgagcttaactatatcctatgggaaaacaacatcaagctgaccgtagtagtcggggacaccatcggcgtgctcgagcagggcaagcgcacgcttacgccccagccgatggagctgaagtactcctggaaaacctgggggaaggcaaaaatcgtcacggcagagacccagaacagcagtttcatcatcgatggtcccaacacacccgaatgcccaagtgctagcagggcctggaacgtgtgggaggtagaggactacggattcggcgtgttcacaacgaacatatggcttaaactacgcgaggtttacacccagatgtgcgaccaccggctgatgagcgcagccgtaaaggacgagcgcgcagtgcatgcggacatgggctactggatagagagccagaagaatgggtcgtggaagcttgaaaaggccagcctgatcgaggtaaagacctgtacttggccgaagagccacaccctctggtcgaacggcgtgttggagtctgacatgatcattccgaagagcttagccgggccgatctcgcagcacaaccatcgtcctgggtatcacacccagacggcagggccctggcacctggaaaacctcgagctggattttacctactgcgaaggcactacggtggtcatcacggagaactgcgggacccgagggccctccttaagaaccaccacggtgtccgggaagttaatccatgagtggtgctgccgaagctgcacactacccccgttaagatacatgggtgaggatggctgttggtacgggatggagatcaggcccatctccgagaaagaggagaacatggtcaagagcctcgttagcgccggaagcggtaaagtggacaacttcaccatgggaatcttatgcctggcaattctctttgaggaggttatgcgtggcaagttcgggaagaagcacatgattgctggcgtttttttcaccttcgtgctgttgctttccggccagatcacgtggcgcgacatggcccacaccttgatcatgatcggttcaaacgcctctgaccggatgggtatgggggtgacctacttagcgctgatcgcgacgttcaaaatacagccctttctcgccctgggattcttcttgagaaagcttacgagcagagagaacttgctcttaggggtcggcctggcaatggccaccacgctgcagcttccggaggacatcgaacagatggccaacggcatagcgctggggttgatggccctgaaactcatcacccaattcgagacataccaactgtggaccgcactaatatccttgacatgcagcaacaccatcttcacgctcaccgtggcctggcgcaccgcgaccctgatccttgccggcgtgagcctcttacctgtgtgccagtccagcagcatgaggaagacggactggctgcctatgacagtcgccgctatgggtgtcccgccgttgccgctgtttatttttagcctgaaggataccttaaagcgcaggagctggcccctcaacgagggtgtgatggccgtggggctggtaagcatcctggccagcagcctgctacggaacgacgtgcccatggccggcccgctcgtggccggcgggctgctgatcgcctgctatgtgatcaccggcacctcggccgacctcaccgtggagaaggcggcggatgtgacctgggaagaggaggccgagcagaccggagtcagtcacaaccttatgatcaccgtcgacgacgacggcacgatgcgcatcaaggacgacgagaccgaaaacatcttgactgtacttctcaagaccgcacttttgattgtctccgggatcttcccatattcgatccccgcgacgctactggtttggcatacctggcagaaacaaacccagcgttccggcgtcctctgggacgtccccagccccccggaaacccagaaggccgagttagaggaaggggtataccgtatcaagcaacaggggatcctgggcaagacccaagttggggtcggcgtccaaaaggagggtgtgttccacaccatgtggcacgtaacccggggcgcggtgctcacccacaacggcaagcgcctggagcccaattgggcctccgtgaagaaggatctgatcagctatgggggcgggtggaggctctccgcccagtggcagaaaggagaggaggtccaggtgatcgcggtcgagcctgggaagaacccaaaaaacttccagacgatgccaggcacctttcagacaaccactggcgagatcggggccatagcactagatttcaagcccggtacatcaggaagccccatcatcaacagagagggaaaggtagtgggcctgtatgggaacggtgtggtcacgaagaatggggggtacgtgtccggtatcgcacaaaccaatgccgaaccggacggccccacgcccgagctggaggaggagatgtttaagaaacggaacctcaccataatggaccttcaccccggctcaggtaaaacccgcaaatacctgcccgctatcgtgcgggaggcaatcaagcgtcggctgcgtaccctgatattagcacccacgcgagtcgtggccgctgagatggaggaggcgctcaagggcctacccatccgctaccagacgaccgcgacaaagtcggagcacacggggcgggagatcgtggacctgatgtgccatgcaacgttcaccatgcgcctgctgagccccgtccgggtgccaaactataacttaattatcatggatgaggcccatttcactgacccggctagtattgcggccaggggctacataagcacacgtgtggggatgggcgaggccgctgctatcttcatgtccgcaacgccgcccggcaccgcggacgccttcccgcagtctaacgccccgattcaggacgaggaaagagacatccccgagcgatcctggaactcagggaatgaatggatcaccgacttcgcgggcaaaacggtctggttcgtgccgtccattaaggctgggaatgatattgcgaactgcctccggaagaatggtaaaaaggtgatccaactgtcgcgcaagaccttcgacactgaataccagaagaccaagctgaacgactgggacttcgtcgtcacaacggacatctccgagatgggtgccaactttaaggccgacagagtgatcgacccgcgccggtgcctcaagcctgtcattctgaccgacggacccgaacgcgtgattctggcgggccctatgccagtgaccgccgccagcgcagcccagagacgcgggcgggtcggccgcaatccccaaaaggagaacgaccagtacatcttcacagggcagcccctcaacaacgatgaagaccacgcgcactggacggaggccaagatgctcctggataatataaacacccccgagggcatcatcccggccttgtttgagcccgagagggagaagtccgcagctatcgacggcgagtaccgcctgaagggcgagagccgcaagacttttgtagagctgatgcgacggggtgatttacccgtgtggctggcacacaaggtggcctccgaggggatcaaatacaccgaccggaagtggtgctttgacggccaacggaataaccaaatcttggaggaaaacatggacgttgagatttggacaaaggaaggggagaagaagaagctcaggcccaggtggctggatgcacgcacctacagcgaccctctggcactcaaggagttcaaggactttgccgctgggcgaaagtctatcgcccttgacttagtcaccgagattggtcgggtgcccagccacctagcccaccgcacccggaacgctctcgacaacctggtgatgctccacacgagcgagcacggcggccgggcctatcggcacgctgtcgaggaattgccagagacaatggagaccttactcttgctggggctgatgattctactgaccggcggtgccatgctctttctcatttccggcaaaggcatcgggaagacgagcattggcctgatctgcgtgatcgcgtccagcggcatgctctggatggcggagatcccgctgcagtggattgcgtccgcaatagtgttggagtttttcatgatggtccttctcatacccgaacccgagaagcaacgcacgccccaggacaaccagctggcatacgttgtaatcggcatcctaaccctggccgcgattatagcggccaatgagatggggctgcttgagacgactaagcgggacctaggcatgtcaaaggagccgggcgtggtgtcccccaccagctatctggacgtagacctccacccagcgtccgcctggaccctgtacgcggtcgccaccacagtgatcacccctatgctgcgccacaccatcgagaatagcacagctaacgtatccctcgccgccatcgcgaatcaggcagtcgtactgatgggactggacaagggctggcccatcagcaaaatggacctcggagtgcctctgctggctctcggatgttactcccaggtcaatcccctgactctcaccgcagcggtgctcctgttgatcacgcactacgcgataatcggacccggcctccaggccaaggccacccgggaggctcaaaagcgcacggcagcgggcatcatgaagaaccctaccgtggacggtatcattaccatagacctggaccctgtcatctacgatagcaagttcgagaagcagctggggcaggtgatgctcttggttctttgtgctgtccagttactgctgatgcggacgagttgggcactctgcgaggccctgacgctggcgaccgggcccatcactaccctgtgggagggatcgcccggcaagttctggaacaccacgatcgcggtctccatggccaacatctttagagggagctatcttgccggcgcggggctggcgttctccatcatgaagtctgtgggtacggggaagcggggaaccggcagccaaggggagacgctaggcgagaagtggaagaagaagctgaaccagctctcccgcaaagagttcgacttgtataagaagtccgggatcacggaggtcgaccggacagaagctaaggagggcctcaaacgtggcgaaactacacaccacgctgtgtccagaggtagcgccaagcttcagtggctggtggaacgtaacatggtcatcccggagggacgagtgatcgatttagggtgcggccgcgggggatggtcctactattgtgccggccttaagaaggtgacggaagtgaggggctatactaaaggcgggcccggccatgaagagccggtgcccatgagcacctacggttggaacatcgttaagctcatgtccggcaaggacgtcttctacctgccaccagagaagtgcgacacattactatgcgacattggggaatcgtccccgagcccgacggtggaggagtcccgtaccatccgcgtgttaaagatggtcgagccttggttaaagaacaaccagttctgcatcaaggtccttaacccctacatgcctgccgtaattgaacacctcgagcggcttcagcgcaagcacggaggcatgctggtccggaaccccctcagccgcaacagcacgcacgagatgtattggatctcaaatggaacaggaaatatagtgtccagcgttaacatggtgagtcgtctgctgttgaatcgcttcacgatgacacaccggcgtccgaccatcgagaaggatgtagatctgggggctggcactaggcacgtgaacgcagaacccgaaacgcccaacatggacgtcatcggcgaacgcatcaaacggataaaggaggagcataacagcacctggcactacgatgacgaaaacccgtataagacctgggcctaccacgggtcttatgaggtgaaggccacaggaagcgcaagcagtatgattaacggggtagtcaagctgctcactaaaccatgggacgtcgtccccatggttacgcagatggcaatgaccgatactactccattcggccagcagcgcgtatttaaggaaaaggtagacacgcggaccccgcgtcccatgcccgggacccggaaagtaatggagattaccgccgaatggctatggcgcacgttgggacgcaacaagcgtccaaggttgtgcacccgcgaagagttcactaagaaggtacgaactaacgcagcgatgggcgccgtcttcaccgaggagaaccagtgggacagcgccaaggccgccgttgaggacgaagagttctggaaactagtggaccgggagcgcgaattacacaagctcgggaagtgtggatcctgtgtctacaacatgatgggtaaaagagagaagaaacttggcgagttcggaaaggcgaagggtagccgcgccatctggtacatgtggctggggtcacggtatttggaattcgaggccctagggttcctgaatgaagaccactggttctcacgcgagaacagttatagcggcgtggagggggagggcttgcataagctggggtacatcttaagagacatatccaagatcccgggcggcgcgatgtacgccgacgacaccgcggggtgggatacccgcatcaccgaggacgacctccataacgaggaaaagataacacagcagatggaccccgagcaccggctgctagccaacgccatcttcaagctcacctaccagaacaaggtggtcaaggtgcagcgccccacacccactggcacggtcatggatatcatatctagaaaggaccaacgcgggagcggtcaagtcggcacctatgggttgaacaccttcacaaatatggaagcccagctagtgcggcagatggagggggaaggagtgctcagcaaggccgacttagagaatccgcacctcccagagaagaagataacgcagtggttggagaccaaaggcgtcgagcgcctcaaacggatggcgatctccggggacgattgcgtcgtgaagccaatcgacgaccgcttcgccaacgccctgctagccctgaacgatatgggcaaagtccggaaagacataccacagtggcagccgagtaagggatggcacgactggcagcaggtgcccttctgttcccaccatttccacgagctgatcatgaaagacggacgaaaactggtggtaccctgccgcccccaggacgagcttatcggccgagctcggatttctcagggggcgggctggtccctgcgcgagacagcctgtttaggtaaggcatacgcgcagatgtggagcctgatgtattttcaccgcagagacctgcgcctcgcctctaacgcaatttgcagcgccgttccggtgcactgggttcctacaagccgaacgacatggtccatccatgcccaccaccagtggatgacaactgaagacatgctgaccgtgtggaaccgcgtatggatagaggacaacccctggatggaggataagacccccgttaccacgtgggagaacgttccgtacttgggcaagcgggaggaccagtggtgcgggtctctcattgggttaaccagtcgcgccacttgggcgcagaacatccccacggccatccaacaggtccggagcctgattggaaacgaggaattcctcgactacatgccctccatgaagcgcttccggaaggaggaggagagtgagggcgcaatctggtaa

SEQ ID NO: 26168 - RNA, 9873 nt, synthetic construct
  misc_feature 1..9873: note = derived and/or modified CDS sequence (opt11) from DENV-3__HQ235027__SS-prME
  source 1..9873: mol_type = other RNA
acctcactgtgcttgatgatgatcctgcctgcggccctggctttccacctaaccagcagagacggcgagccacggatgatcgtggggaagaacgagcgggggaagagtctgttattcaagaccgcgtccgggatcaatatgtgcaccctcatagccatggacttaggcgagatgtgtgacgacaccgtgacctacaagtgcccccacatcacggaggtggagcccgaggacattgactgttggtgcaacttaacaagtacctgggtgacttacgggacttgcaaccaggccggcgaacaccggcgcgacaagcggtccgtagcactcgcaccccacgtgggcatggggctagacaccaggacccagacttggatgtccgccgaaggcgcctggagacaggtggagaaggtggagacgtgggccctgcgccaccctgggttcactatcctggcgctgttcctggcccactacatcggcacctccctaacccaaaaggtggtcatctttatactgttaatgctcgttacgcccagcatgacgatgcggtgcgtaggcgtgggcaaccgggactttgtcgaaggcctatccggggccacctgggtggacgttgtcctagagcacggcgggtgcgtgactacgatggccaagaacaagcccaccctcgatatcgaactgcaaaagaccgaggcaacacaactggctacgttgcgaaagttgtgcatagaagggaagatcaccaacataacaaccgactcacgctgccctactcagggtgaggccgtactgccggaggagcaagaccagaactatgtctgcaagcacacctacgtggatcgggggtggggcaatgggtgcggcttattcggaaagggatccctggtgacctgcgcaaagttccagtgtcttgagccgatcgaaggcaaggtcgtgcagtatgagaatcttaagtataccgtgatcatcacggtccacaccggggaccagcaccaggtcggcaatgagacacagggggtcaccgccgagatcacaccgcaggccagcaccaccgaagcgattctgcccgagtatggtaccctggggctcgagtgctccccgcgcaccggcctggacttcaacgagatgatattactcacgatgaagaacaaggcctggatggtgcataggcagtggttcttcgaccttcccctgccctggacatcgggcgcgactaccgaaacgcctacctggaaccgcaaggagctcctagtgacattcaagaacgcccacgcgaagaagcaagaggttgtggtgttggggtcgcaagagggagcgatgcacaccgccctcacaggcgccatcgagatccagaatagcggcggtacctccattttcgccggtcacctgaagtgccggctgaagatggacaagttagagctgaagggaatgagttacgccatgtgcacgaagaccttcgtcttgaagaaggaggtgtccgagacgcagcatgggaccatcctcataaaggtggagtacaagggtgaagatgctccgtgcaagataccctttagcaccgaagacgggcagggaaaagcctacaatggcaggctgatcacagccaaccccgtggtgactaagaaggatgagccggttaatatcgaggccgagccgcccttcggagaaagcaacatcgtcattggtatcggggacaatgcgcttaaaataaactggtataagaagggctccagcattgggaagatgttcgaggctacggcccggggcgcccgccggatggctatcctgggggacaccgcgtgggacttcgggtccgtcggtggggtgctcaatagcctggggaaaatggtgcaccagatcttcggttccgcctataccgcgttattcagcggtgtctcctgggtgatgaagataggcatcggggtcctactgacgtggattggcttgaactctaagaacatctccatgagcttttcctgcatcgcaattgggatcatcaccctctacctgggggccgtggtgcaggctgacatggggtgtgtcatcaactggaagggcaaggaactgaagtgtggcagcggtatcttcgtgaccaacgaagtgcacacctggacggagcagtacaagttccaggccgactcccccaagcgcctcgccacggcgatcgccggagcgtgggagaacggggtctgcggcatccgctcgaccacccggatggagaacctgctgtggaagcagatagcaaacgagctcaattacatcctgtgggagaacaacatcaagctgacggtggtagtcggagacaccatcggcgtgctcgagcagggcaagcgcaccctgacaccccaaccgatggaactgaaatactcctggaagacgtgggggaaggcgaagatagtgaccgccgagacccagaactcgtccttcattatagacggccccaatacccccgagtgcccctccgcgtcccgcgcctggaacgtctgggaggtggaagattacgggttcggcgtgttcacgacgaacatttggttgaagctgcgagaggtttacactcaactctgcgaccatcggctcatgagcgctgccgtgaaggacgagcgcgctgtgcacgccgacatgggctactggatcgagagccagaagaacgggtcctggaagctagagaaggcctctttaatcgaggtgaagacctgcacctggccgaaatctcacacgctctggtcgaacggcgtcctggagtccgacatgattattcccaagtcactggccgggcccatctcccagcataatcaccggccggggtaccacacgcagaccgccgggccctggcacctcggcaaacttgagctggatttcaactactgcgagggcaccacggtggtcatcaccgagaactgcgggacgcgcggcccaagcctccggacgaccactgtgtccgggaagttaatccacgagtggtgctgtcgctcatgcacactgccgccgctccgctacatgggcgaggacgggtgctggtacggcatggaaattcgccccatctccgagaaggaggagaacatggtcaagagcctggtctccgccgggtcagggaaggtcgacaacttcacgatgggtgtcctgtgcctcgcgatcctgttcgaggaagttatgcgtgggaagttcggcaagaaacacatgatcgcaggcgtgttcttcacgttcgtcctgttattatccggccagatcacatggcgcgacatggcacacaccctgattatgatcggcagcaacgcctctgaccggatggggatgggcgtcacatatcttgcactaatagcaactttcaaaatacagccgttcctggccctcgggttcttcctaaggaagctgacgagccgggagaacctcctcttaggcgtaggcttagccatggccaccaccctgcagttgcccgaggatattgagcagatggcgaacgggatcgctctcggcctgatggccctgaagctgatcacgcagttcgagacctaccagctctggaccgccctgatctctctgacctgctccaacacgatgttcaccctgaccgtggcatggcgcaccgcgacgctgatcctcgccggggttagcctacttccagtttgccaatcctcctccatgcggaagaccgattggctccccatggcggtcgcagcgatgggcgtgccaccccttccgctgtttatcttcagcctcaaggacaccctgaagcgccgctcttggcccttgaacgaaggggtcatggcggtcggcctcgtgagcattctggccagtagtctgctgcggaacgacgtgcccatggccggcccgctggtcgccgggggtctcctcatcgcctgttacgtgattacgggtacctcggcggacctgaccgtggagaaagccgccgacattacatgggaggaggaggccgagcagactggcgtatcacacaacctaatgatcacggtggacgacgacgggacgatgaggatcaaggacgacgagaccgagaacatcctcacggtgctgctgaagaccgccctcctggtcgtgtccggcgtcttcccgtacagcatccctgctacgctgctcgtctggcatacctggcagaagcagacccagcggtccggggtgctgtgggacgtaccctccccgcccgagacccagaaggcagagttagaggagggggtctatcgcatcaagcagcagggcatatttggaaagacccaggtgggcgtgggggtccagaaggaaggcgtgttccacactatgtggcatgtgacccggggcgccgtcttaacctacaacggtaagagactggagcccaactgggccagcgtcaaaaaggacctgatcagctacggcggcggctggcgactaagtgcccagtggcagaagggggaagaggttcaggttatcgcggtggagcctggaaagaaccccaagaacttccagacgatgcccggcaccttccaaaccacaacgggggagatcggcgccatcgccctggacttcaagcccgggacctcaggctcccccataataaacagggagggcaaggtagttgggctgtacggcaacggagtagtcaccaagaacggagggtacgtctccggcattgcgcagaccaacgcggagcctgatggccccacgcccgaactggaggaggagatgttcaagaagcggaacctcaccatcatggatctgcacccggggagtggcaagacccgcaagtacctgccagccatcgttcgcgaagcaataaagcgccgactccgcacactgatcctggcgcccacgcgcgtggtggcagcagagatggaggaggccctcaaaggtctgcccatcaggtatcagaccaccgctacgaagtccgagcacactggccgggagatcgtggatctgatgtgtcacgcaaccttcacgatgcgtctcctgtcacccgtgagagttccaaattataacctgatcataatggatgaggcccacttcaccgaccccgcgtctattgcagcacgcggttacatctctacgcgggtagggatgggagaggccgcggccatattcatgacagccaccccgcccgggaccgccgatgccttcccgcaatctaacgcgccgatccaggacgaggagcgcgacatccctgagaggagctggaacagtggcaacgagtggataacggactttgccgggaagaccgtttggttcgttcccagcatcaaggctgggaatgacatcgccaactgtctccggaagaatgggaaaaaggtgatacagctgagcaggaagactttcgacactgaataccaaaagacgaagctgaacgactgggatttcgtggtcaccaccgacatcagcgaaatgggcgcgaacttcaaagcggaccgggtgatcgacccacgccggtgcctcaagcccgtaatcctgaccgacggccccgaacgcgttatcctggccgggcccatgccggtgaccgccgcctcggcagcccagcgcagaggccgggtggggcgcaacccccaaaaggagaacgaccaatatatcttcacgggccagcccctcaacaatgacgaggaccacgcccactggaccgaggccaagatgttgctggacaacatcaacacccccgagggaatcattccggccctttttgagcccgaacgggagaagtcggcggccatagatggcgagtaccgccttaagggcgagagccggaagaccttcgtcgagctgatgcgccgcggggacctccccgtgtggctggctcacaaggttgcctcagaaggcatcaagtacacggaccgcaaatggtgcttcgacgggcagcggaacaaccagatcctggaagagaatatggacgtggagatctggacgaaagagggcgagaagaagaagctccgccctcggtggttggacgcccgcacctactcagacccgctggcgctcaaggagttcaaggactttgccgccggccgcaagtctatcgcccttgacctggtgaccgagatcgggcgggtcccctcccacctcgctcaccgcacccggaacgcgttggacaatctggtgatgctccatacctcggaacacggcgggcgcgcctaccggcacgccgtcgaggagttacccgagaccatggagacattactcctgctgggcttgatgatcttgctgaccggcggggccatgctgttcctgatcagcgggaaggggatcggtaagacgtccattgggctgatctgcgtcatagcttcctccggtatgctatggatggcggagatcccgttacagtggatcgccagcgccattgtgctggagttcttcatgatggtgctcctgatccccgagcccgagaagcagagaacgccgcaggacaaccagctggcctacgtagtgatcgggatcctcaccctggccgcaatcatcgctgccaacgaaatgggcctgttggagacgactaagagggacctcggtatgagcaaggagcctggggtggtcagccccacctcctatctggacgtggacctccaccccgccagtgcgtggacgctgtacgcagtggccacgacagtcatcacgccgatgctgaggcacaccatcgaaaattccacggcaaacgtgagcctcgccgcaatagccaaccaagccgttgtcctgatgggacttgacaaagggtggccgatatccaagatggacctgggcgttcccctgctcgccctcgggtgctacagccaagtgaaccccttaaccttaaccgcagccgtactcctactgattacccactacgccatcatcggcccgggccttcaggcaaaggccacgcgggaagcccagaagcgcactgccgccgggatcatgaaaaacccaacagtggatggcatcatgaccatcgacctggatccggtgatctacgattcaaagtttgagaaacagctggggcaggtaatgctcctggtactgtgcgccgtgcagttgctgctgatgagaaccagctgggcgctctgcgaggccttgacactggccaccgggcccatcaccacgttatgggagggcagtcccgggaagttctggaacaccaccatagctgtctcaatggccaacattttccgcggttcctacctggcgggggcgggcctagcctttagcataatgaaaagcgtggggaccggcaagcggggcacggggagccagggggaaacactcggggagaagtggaagaagaagctgaaccagctgtcgcgcaaggagttcgaccggtataagaagtccgggatcaccgaggtggaccgcacggaggcgaaggagggcctcaagcggggcgaaaccacgcatcacgccgtcagccgcggctccgccaagctccagtggttcgtcgagcggaacatggtgatcccggaggggcgtgtcatcgacctgggctgtggacggggcgggtggagctactactgcgcgggattaaagaaggtgaccgaggtgcgcgggtacacaaaaggagggcccgggcacgaggagccagtacccatgtccacctatggctggaacattgtgaagttaatgagcggtaaagacgtgttctacctgccgcctgaaaagtgcgacacgttgctgtgcgacattggcgagtccagccccagtcccaccgtcgaggagtcccgcacgattcgagtgctgaagatggtagagccgtggctgaaaaacaaccagttctgcatcaagatactcaatccctacatgcccaccgtcatcgagcacctggagagactccagcggaagcacggcggaatgctagtgcgcaaccccctgtcccgaaacagcacgcatgagatgtactggataagtaacggcactgggaacatcgtggccagcgtcaacatggtctcccgcctgctccttaaccgtttcaccatgacccatagacggccgacgatagagaaagacgtggacctaggcgctggaacacgacatgtcaacgctgagcccgagacccccaacatggacgtgatcggggagagaatcaagcgtattaaggaagaacacaacagcacttggcactacgacgacgagaacccgtacaagacgtgggcctaccacggctcctacgaggtgaaggcgaccggctcggccagcagcatgattaatggcgtcgtgaaactcttgaccaaaccgtgggacgtggtgcccatggtaacccagatggccatgacggacaccacccccttcgggcagcagcgggtattcaaggagaaggtggacacccgcacgccgaggtctatgccgggtacccgcagagtaatgggcataacggcggagtggctgtggcgcaccctcgggcggaacaagaagcctcgcctatgcacgcgcgaggagtttacaaagaaagtccggaccaatgcggccatgggggctgtgttcacagaggagaaccagtgggactcggccaaagccgccgtggaggacgaagacttctggaagctggtcgaccgcgagcgggaactacacaaacttgggaagtgcggctcctgcgtatataacatgatggggaagcgcgagaagaagctgggcgagttcggcaaggccaaagggtcccgcgccatctggtacatgtggctcggtgccagatacctggagttcgaggccctgggcttcttgaatgaggaccactggttctcacgggagaactcctacagcggcgtggaaggggaaggcttgcacaaactgggctacattttgcgcgacatctccaagatcccagggggcgctatgtacgccgacgacacggcagggtgggatacccggataacagaggacgacctgcacaacgaggaaaagatcactcagcagatggacccggagcaccgccagctggccaatgcaatcttcaagctaacgtatcagaacaaggtggtgaaggtgcagcggcccacccccaccggcaccgttatggacatcatctctcgaaaggaccagcggggcagcggccaggtgggtacctacgggctgaacacgttcaccaacatggaggcgcagctgatacgccagatggagggtgagggggtgctcagcaaggcggatctggagaacccccacctccccgagaagaaaatcacccagtggctcgaaacgaagggcgtagagagactgaaacgcatggccatctccggcgatgactgtgtggtgaaacccatcgacgatcggttcgccaatgccctgctcgcgctgaacgacatgggcaaggtccgaaaggacatcccccagtggcaacccagcaagggttggcacgactggcagcaggtccccttttgcagccaccacttccacgagctaatcatgaaggacggacggaagctggtggtcccctgccgcccgcaggacgagctgattggcagagctcggataagccaaggggccggctggagcctccgcgagacggcctgcctcggcaaggcatacgcgcagatgtggtcactcatgtactttcaccggcgcgacctgcggctcgcctccaacgccatctgcagcgccgtgcccgtgcactgggtcccgacctcccgcaccacctggtcaattcatgcgcaccaccagtggatgaccaccgaggacatgctgaccgtgtggaatcgggtgtggatcgaggacaacccctggatggaggacaagacccccgtgacgacttgggaggatgtgccctacctgggtaagcgtgaagaccagtggtgcggcagcctcatcggacttacgagccgggccacatgggcccaaaacatcccgacggccatccagcaggttcgcagcctgattggcaacgaggagttcttggactatatgccctccatgaagcggtttcgaaaggaggaagagagcgagggggccatatggtga

SEQ ID NO: 26169 - RNA, 9873 nt, synthetic construct
  misc_feature 1..9873: note = derived and/or modified CDS sequence (opt11) from DENV-3__JQ920476__SS-prME
  source 1..9873: mol_type = other RNA
accagcctgtgcttaatgatgatgctccccgccacactggcattccacctcaccagccgggatggcgaaccccggatgattgtggggaagaacgagcgtgggaagagccttctgttcaagaccgcgagcgggatcaacatgtgcaccctcatagcgatggacctgggagagatgtgcgacgacactgtgacctacaagtgccccctgatcacggaagtggagcccgaggatatcgactgctggtgtaacctcaccagcacctgggtgacctacgggacctgcaaccaggcgggcgagcaccgccgagataagcgttccgtcgccctagcgccgcatgtgggcatggggttagacaccaggactcaaacctggatgagcgcggagggcgcctggcggcaagtcgagaaggtcgaaacctgggcgttcagacaccccggcttcaccatcctggcgctgttcctggcgcattatatcggtacctccttaacgcaaaaggtcgtgatctttatcctgctcatgctcgtcaccccctcaatgaccatgcgttgtgtgggcgtgggcaaccgagacttcgtggaaggcctttccggggccacatgggtggacgtggtcctggagcacgggggttgcgtaacgactatggcaaagaacaagcccaccttagatatcgagctgcagaagaccgaggccacccagttggctaccttgcgtaagttgtgtatcgagggcaagataaccaacgttacgacggatagccggtgccccacccagggcgaggcaatcctgcccgaagagcaggaccagaactatgtctgcaaacatacctacgtggaccgggggtgggggaacgggtgtggcctcttcgggaagggctccctggtgacatgcgcaaagttccagtgcttagaaagcatcgagggcaaggccgttcagcacgagaacctcaaatatacggtcatcatcaccgtgcataccggagaccagcaccaggtcggcaacgagacgcagggggtgacggccgagatcactccccaggcctccaccgtcgaggctatactgcccgagtacggcacattgggactcgagtgctcaccccggaccggactggacttcaacgagatgattctgctcaccatgaagaacaaggcctggatggtgcaccgtcagtggttctttgatctgccgctgccctggacctctggcgccaccaccgagacgcccacctggaataaaaaggagctcctagtgacgttcaagaacgcccatgccaagaagcaggaagtcgtggttttaggtagccaggaaggcgcgatgcacaccgccttaacgggggcaaccgagatccagaccagcggcggtaccagcattttcgccggacacctaaagtgtcgcctaaagatggataaactagagctcaagggcatgtcctacgccatgtgcctgaatgcgttcgtgctcaaaaaggaggtatccgagacgcaacacggcaccatccttatcaaggtggagtacaagggggaggacgccccatgcaagatccctttctcaaccgaggatgggcagggcaaggcgcacaacggacggctgattacagccaaccccatcgttacgaaaaaggaggagcctgtgaacatcgaggcggaacctcctttcggggagtccaacatcgtcatcggcataggggacaaggctctgaagataaactggtataagaaagggtcatccatcgggaagatgttcgaagccacggcccgcggcgcacggcggatggcgattctcggcgacaccgcctgggactttgggagcgtcggcggtgtgctaaactccctgggaaagatggtccaccaaatcttcggtagcgcatacaccgcactcttcagtggcgtcagctggatcatgaagatcggtatcggagtgttactgacgtggatcggcttgaactcgaaaaacacctctatgtcgttcagctgtatcgtgatcggcattatcaccttgtatcttggcgccgtagtgcaggcggacatggggtgcgtgatcaactggaaaggcaaggagctcaaatgtggctccggcatcttcgtaaccaacgaagtgcacacgtggacagagcagtacaagttccaggccgacagccccaagcgcctggccacggccatcgccggcgcgtgggagaacggtgtctgcggcatccgctccaccacgcgtatggagaatctgctttggaagcagatcgcaaatgagctaaactacatcctgtgggagaacaatatcaagctcacgatcgtcgtaggggacgtgataggcgtcctggagcagggcaagcggaccctgacgccccagcccatggagttaaaatacagttggaagacgtgggggaaggccaagatagtgaccgccgagacccagaattccagctttatcattgacggcccgaatacgcccgagtgtcccaacgcgtctcgtgcgtggaacgtttgggaggttgaggactacgggttcggcgtgttcacgactaacatctggttgaagttacgggagatgtacacccagctctgcgaccaccgcttgatgagcgcggccgtgaaggatgagcgggcggtccacgcggacatgggatactggatcgagagccagaagaacgggagttggaaactcgagaaggcgagcctgatcgaggtaaagacctgcacttggcccaagagccacacgctatggagcaacggcgtcttggagtccgacatgatcatccccaagagtctcgccgggcccatctcccaacacaactatagaccgggctaccatacccagaccgctggaccctggcacctgggtaagctggagctagacttcaattactgcgaaggcaccaccgtggtgatcacggagaactgcgggacccgcggacccagcctgcgcactacgaccgtgtcgggaaagctgatccacgaatggtgttgccggagctgcacattgccgcctctccgctacatgggcgaggacgggtgttggtatggcatggagatccggccgatcaacgagaaggaggagaatatggtcaagtccctggtgagcgccggctcaggtaaagcggataacttcacgatgggcgtgctctgcctggccatcctgttcgaggaggtcatgcgcgggaagttcggcaagaagcacatgatcgctggggcgctcttcacgtttgtgctcctgctaagcggccagatcacctggcgggacatggcgcacacattaatcatgatcggctccaacgcgtcagaccgaatgggaatgggcgtgacctacctcgccctcattgccacgttcaaaatacagcctttcctggccctggggttcttcctccgaaagttaacctcccgtgagaacctgcttctgggcgttggcctggcaatggccaccaccctccagctgcctgaggacatcgaacagatggccaacgggatcgcgctgggcctcatggccctgaaattaatcacgcagtttgagacttatcagctctggactgctctggtgtcactgatgtgcagcaacaccatctttacgctaaccgtggcgtggcggaccgccaccctgatcctggccgtcatctcactcctgcccgtctgccaaagctcctctatgcgcaaaacggactggctgccgatgaccgtagccgcgatgggggtgccgccactcccactgttcatcttttcgctgaaggacaccctcaagcggcgcagctggccgttaaacgaaggcgtgatggccgtcgggctggtttctatcctcgccagcagctttctgcggaacgacgtgcccatggctggacccctggtcgccggtgggctcctgatcgcatgctacgtgatcacggggacgtccgccgatctgaccgtcgagaaagcggcagatgtcacctgggaggaggaggcggagcagacgggggtctcccataacctcatgatcacggtggacgacgacggcaccatgcggattaaggacgacgagaccgagaacatcctgactgtcctgctcaagaccgcattactgattgtcagcgggatcttcccctactcaatcccagcaactctcctggtgtggcacacctggcagaagcagacccagcgcagcggcgtcctgtgggacgttcccagccctccagagacccagaaagccgaactcgaggagggcgtgtaccggatcaagcagcaaggaatcttcggcaagacgcaggttggtgtgggcgtgcagaaggagggggtcttccataccatgtggcacgtgacccgcggcgccgtgctgacccataacgggaagcggctggagccgaactgggcgaacgtcaagaaggacctcatcagctacggcggcggttggaaactgtccgcgcagtggcagaagggcgaggaagtccaggttatcgccgtcgagcctgggaaaaaccccaagaacttccaaaccatgcctggaatcttccaaaccaccaccggagaaatcggcgccatagccctggactttaagcctgggacgtcggggtcccccatcataaaccgcgagggcaaggttgtgggcctgtatgggaatggcgtcgtgaccaagaacggaggctacgtgagtgggatagcgcagaccaatgcggagcccgacggaccgaccccagaactcgaggaggagatgtttaagaagcgcaatctgacgattatggacctgcaccccggcagcggcaagactcggaagtaccttcctgccatcgtccgggaggcgatcaagaggaggctgcgtaccctgattctagccccgacccgggtggtggcagctgagatggaggaggccctgaagggcttacccatccgctaccagacgaccgccacgaagtccgagcataccgggcgggagatcgttgacttaatgtgccacgccacgttcaccatgagactgctgagccccgtgcgggtgcccaactataaccttatcgtcatggacgaggctcacttcaccgacccagcctccatcgccgccaggggttatatctcaacccgggtgggcatgggggaagcggcggccatctttatgacggccacgcccccggggaccgcagacgcgttcccccaatccaacgccccgatccaggacgaggagagagacatccctgagcggtcatggaattccgggaacgagtggatcaccgatttcgctggcaagactgtgtggttcgtgcccagcataaaggcagggaacgatattgccaactgcctgaggaagaacggaaaaaaggttatccagctgtcccgcaagaccttcgacacagagtaccagaagaccaagctcaacgactgggacttcgtggtcactaccgacatcagcgaaatgggggctaacttcaaggccgaccgggtcatagacccccgccggtgcctgaaaccggtgatcttgactgacgggcctgagagagtcatcttggccggccccatgcccgtgacagtggccagcgctgcgcagcggagggggcgggtaggccgcaacccgcaaaaggagaacgaccagtatatctttacggggcagcccctgaacaacgacgaggaccatgcccactggacagaggccaaaatgttactagataacatcaacacccccgagggcattatccccgcccttttcgagccggaacgagagaaatccgcggccattgacggggagtaccgcctgaaaggtgaatcccggaagacgttcgtggagctcatgcgccggggtgacctgccggtgtggctggcacataaggtagcgagcgaggggatcaagtacacggaccgcaaatggtgcttcgatggcgagcggaacaaccagatcctcgaggagaacatggacgtggagatctggacaaaggagggggagaagaagaagctgcgtccccgctggctggacgcacgcacctacagcgaccccctcgcgctgaaagagttcaaggactttgctgccggccgcaagtcgatcgccctggacctcgtcacagagataggccgcgtgcctagtcaccttgcccatcgcacccggaatgcgctcgacaacctcgtgatgctacacactagcgagcacggcggccgcgcctacagacacgccgtcgaggagctgcccgaaaccatggaaacactactcctgctcggactgatgatcctgctcacaggaggagccatgctgttcctgatctccggtaagggcatcgggaagacgtcaatcggcttaatctgcgtggttgcatcttccggaatgctgtggatggcggatgttcccctgcagtggatcgcctctgccatcgtgctagagttcttcatgatggtgctgctgatcccggaaccggaaaagcagcgcacgccgcaggacaatcagctggcctacgttgtgattggaatcctaaccctggccgcgatcgttgctgcaaacgagatggggctcctggagaccacgaagcgggacctaggcatgtccaaggaaagcggcgttgtgtcccccaccagctaccttgacgtggacctacacccggccagcgcctggaccttgtatgccgtcgctactacggtgatcacccccatgctccgacacaccatcgagaactcgaccgccaacgtctccctggccgcgatcgccaaccaagccgtcgttcttatgggactcgacaaaggctggcccataagcaaaatggacctgggggtgcccctgctggccctgggctgctactcccaggtcaacccgctgacgctcaccgcggcggtgctgctcctcgtgacccactacgcgatcatcgggcccggcctccaggctaaagccacccgggaggcccagaagcgcaccgcggccggcatcatgaagaaccccaccgtcgacgggatcatgaccatcgacctggacccagtaatctacgacagcaagttcgagaaacaactcggccaggtgatgcttctggtcctctgcgccgtgcagctgctgctcatgcggacatcctgggcgttctgcgaggcgctgacgctggccaccgggcccatcacgactctctgggagggcagcccgggcaagttctggaacacgaccatcgccgtgagtatggccaacattttccgcggcagctacctggccggcgcggggctggccttttccatcatgaagtcagtcggcacgggtaagaggggaaccggatcccaaggtgagaccctcggggaaaagtggaagaagaagctgaatcagttaagccgaaaagagtttgatctctacaagaaatctgggatcactgaagtggaccggaccgaggccaaggaaggcctgaagcgcggggagatcacacaccacgcagtgtcacggggaagtgccaagttacagtggttcgtagaacgcaacatggtgatcccagagggcagggtgatcgacctcgggtgtggtcgcggcggatggtcctattactgcgctgggctgaagaaagttaccgaggtgcgaggctacacaaagggcggtcctggccacgaggagccggtgcctatgagcacctacggttggaacatagtcaagctgatgtccggcaaagacgtgttttacttgccgcccgagaagtgtgacaccctgttatgcgacattggggagagctccccgagccccactgtggaggaatcccgcactatccgggtcctgaagatggtggagccgtggcttaagaataaccagttctgcatcaaggtgctgaacccttacatgccgaccgttatcgagcacctggagaggctccagagaaagcacggtgggatgctggtgcggaaccccctcagccgtaactccacacacgagatgtactggatcagcaacgggactggcaatatcgtgtccagcgtaaacatggtgagtaggctccttctgaatcgcttcacgatgacgcaccggaggcctacaattgagaaggacgtggacttaggggccggcacccggcacgtgaacgccgagccggagacaccgaacatggacgtgatcggcgagcgcatacggcgcatcaaggaggaacactcttccacctggcactacgacgatgagaatccctacaagacctgggcataccacgggagttacgaggtgaaggcgaccggctcggcgagcagcatgataaacggtgttgtgaagctgctgacaaagccttgggacgtcgtgccgatggtgacccagatggccatgaccgacaccacgcctttcggccagcaacgggtcttcaaggagaaggtggacaccaggacgccgcggcccatgccgggaacccgcaaggtgatggagataaccgccgagtggctctggcgaaccctgggccgaaacaagcggccccgcctgtgcacccgagaagaatttatcaagaaggtgcgtaccaacgccgccatgggcgccgtgttcacagaggaaaaccagtgggactcagctcgggccgcggtggaggacgaggaattctggaagctcgtggaccgggagcgcgagttacataagctggggaagtgcggcagctgcgtgtacaatatgatggggaagagggagaagaagctgggcgagttcgggaaggctaaaggatcccgcgccatctggtatatgtggctgggcgcacggtacctagagtttgaggcgcttgggttcctgaatgaggaccactggttcagccgcgagaactcccactccggcgtggaaggggagggcctgcacaagctcgggtacattcttcgggacatttccaagatcccaggcggcgcgatgtatgccgacgacaccgcagggtgggacacccgcatcacagaggacgatctgcacaacgaggagaagattactcaacagatggacccagagcaccgccaactcgccaacgctattttcaagctgacctaccagaataaggtagttaaggtacagcggcctacccccaagggtaccgtcatggacataatcagccgtaaggaccagcgcgggtccggccaggtaggaacgtatgggctgaacaccttcaccaacatggaagcccaattaatccggcagatggaaggcgagggggtgctatctaaggcggacctggagaatccccacttactagagaagaaagtcacccagtggttagagaccaaaggcgtggagcgcctcaagcggatggccattagtggggatgactgcgtagtcaagcccattgatgaccgcttcgccaacgcccttcttgccctcaacgatatgggcaaggtccggaaggacatcccccagtggcagccttctaagggctggcacgactggcaacaggtccccttttgctcccaccactttcacgagctgattatgaaggatgggcgcaagctggtggtaccctgccggccgcaggacgagctcatcggacgcgcgcgcatcagccagggggccggctggtccttgagagagacggcctgcctggggaaggcctatgcgcagatgtgggcccttatgtacttccacaggcgggatctgcggctggccagcaacgccatctgctccgccgtgccggtccactgggtgcctaccagcagaacgacctggtccatccatgcgcaccaccagtggatgacgactgaggatatgttaaccgtgtggaaccgcgtctggatcgaggacaacccctggatggaggacaagaccccggtaacgacctgggaggacgtgccctacctgggcaaacgcgaggaccagtggtgtggcagcctgatcggccttacctcacgcgctacctgggcccagaacatccttacagccatccagcaagtccggtccctgatcggcaacgaggagttcctggactacatgcccagcatgaagcgctttcggaaggaggaagagtccgagggagccatatggtga

SEQ ID NO: 26170 - RNA, 9873 nt, synthetic construct
  misc_feature 1..9873: note = derived and/or modified CDS sequence (opt11) from DENV-3__JQ920477__SS-prME
  source 1..9873: mol_type = other RNA
acaagcctgtgcctgatgatgatgctgcccgccaccctcgcatttcacttgacttcccgggacggcgaaccccggatgatcgtggggaaaaacgagcgcggaaaatccctgctgttcaagaccgcctcgggtattaacatgtgcaccctcatcgccatggacctcggcgagatgtgcgacgacaccgtcacctacaagtgtcccctgatcaccgaggtggagcccgaggacattgactgctggtgcaacctcaccagtacttgggtgacctatgggacctgcaaccaagcgggcgagcaccgtcgcgacaagcggtcagtggctctagcgccccacgtgggcatgggcctggacacccgcacccagacctggatgtccgcggagggcgcatggagacaggttgaaaaggtcgagacctgggccttccgccaccccgggttcaccatcctcgcgctgttcctggcccactatatcggcacctcactcacgcaaaaggtagtgatcttcatcctgctcatgctcgtcactcccagcatgactatgcggtgcgtgggggtgggcaaccgagactttgtcgagggcctgtccggggccacctgggtggacgtggtcctggaacatggcggttgtgtgacgaccatggccaagaacaagccgaccctcgacatcgagctgcagaagaccgaggcaacgcagttggccaccctccgcaagctgtgcatcgagggcaagatcaccaacgtaaccactgatagcagatgccccacccagggtgaggcgatactgcccgaggaacaagaccaaaactacgtctgcaagcatacatacgtggaccgggggtggggcaatgggtgcgggctttttggtaagggctccctggtgacatgcgccaagttccagtgcctggaaagcatagagggcaaggcagtccagcacgagaacctcaagtacaccgttataatcaccgtgcacaccggggaccagcaccaggtcggcaacgagacacagggggtcaccgccgagatcacgcctcaggcttccaccgtcgaagcgatcctgccagagtacggcaccctcggactcgagtgctcaccccgcaccgggcttgacttcaacgaaatgatcctgctcacgatgaagaacaaggcatggatggtgcaccggcagtggttcttcgacctaccgctgccctggacctccggcgccactaccgagacgcccacatggaacaaaaaggagctcctggtgacattcaagaacgctcatgcgaagaaacaggaggtggtagtactggggtcacaggagggcgcgatgcataccgccttgacgggcgccacggaaatccagacctccggcgggacctccatcttcgccggccacctgaagtgtcgcctgaagatggacaagttagaactaaagggcatgtcctacgccatgtgcctgaacgcgtttgtcctcaagaaagaggtgagcgaaacgcagcacgggaccattctgatcaaggtggagtacaagggcgaggacgccccctgcaagatacccttcagcactgaggacggtcagggcaaggcccataacggcagactcatcaccgcaaaccccatcgtgacgaagaaggaggagcccgtgaatattgaggccgagcctcctttcggggagtccaacatcgtgatcggcatcggtgacaaggctctcaagatcaattggtacaagaaaggtagctccattggtaaaatgttcgaggccaccgcccgaggcgcccggcggatggcaatcctcggggacaccgcctgggatttcgggagcgtgggaggtgtgctgaactccctgggcaagatggtgcaccagattttcgggagcgcatataccgcactcttctctggagtcagctggattatgaagatcggcatcggggtcctgcttacctggatcgggctcaactccaaaaacaccagcatgtccttcagctgcatcgtgatcggaatcatcaccctgtacctgggcgccgtcgtgcaggcggacatggggtgcgtgatcaactggaagggcaaagagctgaagtgcggaagcgggatctttgttaccaacgaggtccacacgtggaccgagcagtataaattccaggccgacagccccaagcggctggccaccgcaatcgctggcgcgtgggagaacggggtgtgcggcatccgctccactacacgcatggaaaacctactctggaaacagatcgccaacgagctgaactacatcctgtgggagaacaacatcaaactcacgatcgtcgtgggggacgtaattggcgtcttagagcagggtaagcggaccctgacaccccagcccatggagttaaagtactcatggaagacttggggtaaggctaagatcgtcaccgccgagactcagaatagttctttcattatcgacggcccgaacacccccgagtgcccctccgcgctccgcgcgtggaatgtgtgggaggttgaggactacgggttcggtgtctttacgaccaacatctggctgaaactccgggagaaatacacacagctgtgtgaccaccgcttaatgagcgctgcagtgaaggacgagcgagcagttcatgcggacatggggtactggatcgagagccagaaaaacgggtcctggaagctcgagaaggcaagcctgatcgaagtgaagacttgcacctggcccaagtcccacacgttatggagcaacggcgtgctcgagtccgacatgataattcccaagagcctagccgggcctataagccagcacaactatcgacccggctaccatacccaaaccgccgggccgtggcacctgggcaaacttgagttggactttaactactgcgagggtaccactgtcgtgatcaccgagaactgtgggacccggggccccagcctgagaaccacgacagtttccgggaaactcatccacgagtggtgctgccggtcctgtacccttccgcccctgcgctacatgggagaagacggctgttggtacggaatggagatccggccaatcaacgagaaggaggagaacatggttaagtccctcgtgagcgccggttcagggaagaccgacaacttcacgatgggcgtgctctgcctggctatcctcttcgaggaggtcatgagggggaagttcggtaagaagcacatgatcgccggggcgctgtttaccttcgtcctgctcttaagcgggcagatcacatggcgggatatggcccacacactgatcatgatcggctccaacgccagcgaccgaatgggaatgggcgtgacttacttagcgttaatcgccaccttcaagatccagcccttcctggccctagggttctttctgcggaagttaacatcccgcgagaacctcctgctgggcgtcggactcgcgatggcgaccactctgcagctacccgaggacatcgagcagatggctaacggaatcgccctgggcctgatggccctgaaactcataacccagttcgaaacataccagctgtggaccgcactggtgagcctcatgtgcagcaacactatcttcacgctgaccgtagcgtggcggaccgcaacgctgatcctcgctgtcatctcactgctgccagtatgtcaaagcagtagcatgcgcaagaccgactggcttccgatgaccgttgcggccatgggtgttccgccattgcccttgttcatcttctccttaaaagacaccctgaagcggcgcagctggccgctgaacgaaggcgtgatggccgtcgggctcgtgtccatcctagccagctccttcctgaggaacgacgtcccgatggccggccctctcgtcgccggcgggctgctgatcgcttgctacgtgatcacgggcaccagcgcggacctcactgtggaaaaggcagccgacgtcacctgggaagaggaggccgagcagacgggggtgagtcacaacctgatgatcaccgtggacgacgacggcacgatgcggataaaggacgacgaaaccgagaacatactgaccgtactccttaagacggcactgttgatcgtgtcggggatcttcccttactccatcccggcgaccctgctggtgtggcacacctggcaaaaacagacccagcgcagcggcgtcttatgggacgtcccaagcccgcccgagacgcaaaaggccgagctggaggaaggcgtttaccggatcaagcagcaggggatctttggcaagacccaagtcggggtgggcgtgcagaaggagggggtcttccacaccatgtggcacgtgacccgcggcgcagtgctgacgcacaacggaaagcggctcgagccgaactgggcaaacgtgaagaaggacctcattagctacgggggcgggtggaagctgtccgcgcagtggcagaagggcgaggaggtccaggtgatcgccgtcgagcccgggaagaaccccaagaattttcagactatgccgggcatcttccagaccaccacgggcgagattggggccattgcactggacttcaagccgggcaccagtggctcccccataatcaaccgcgagggcaaggtagtgggcttgtacgggaacggcgtagtgactaagaacggcggctacgtgagcgggatcgcgcagaccaacgcggagcctgacggccccacgcccgagttagaagaggagatgttcaaaaagcggaacttaaccattatggacctacacccagggagcgggaagacccgcaaataccttcccgccatcgtccgtgaggccatcaaaaggcggctgcgcaccttgatcctggcgccgacgcgggtggtggccgctgagatggaggaagccctgaagggcttacccatcaggtatcagacgaccgccaccaagtccgagcataccgggcgggagatcgtggacctgatgtgccacgccaccttcaccatgcgcttgctcagcccagtgagagtgccgaactacaacctgatcgttatggacgaagcacatttcaccgacccggcttccatcgccgcccggggatacatcagcacgcgggttgggatgggagaggccgctgccatttcgatgacagctacgccgcccggcaccgccgacgccttcccccaaagcaacgctccgatccaggacgaggagcgcgacatccccgagcggtcctggaacagcgggaacgagtggatcacggacttcgccggaaagacagtctggttcgtcccctccatcaaggctgggaacgacatcgcgaactgcctgcgcaagaacgggaagaaggtgatccaattgtcccgcaagacctttgacaccgaataccagaaaacgaagctgaacgactgggacttcgtggtcaccaccgacatctccgagatgggggctaacttcaaagcggaccgggtgatcgatccccgccggtgcctgaaaccggtcatcctgaccgacggccccgaacgtgtaatacttgccggccccatgcccgtgacggtagccagcgcagcccagcggcgtgggcgggtcggccgaaactcccagaaggagaacgaccagtacatctttaccgggcagccactgaacaacgacgaggaccatgcccactggaccgaggccaagatgcttttagacaacatcaacacccccgagggcatcatccccgccctgttcgagcctgagcgggagaagtcggccgcgatcgacggggagtaccgcctcaagggtgagtcccggaagaccttcgtggagctcatgcgccggggagacctcccggtgtggctcgcgcacaaggtcgccagcgagggcataaagtatacggatcgcaagtggtgtttcgacggcgagcggaacaaccagatcctggaggagaacatggacgtggagatctggaccaaggagggggagaagaaaaagctgcgcccccggtggttagacgcgcgcacctactccgaccccctggccctcaaggaatttaaggactttgctgccggtaggaagtcgatcgcactcgacttagtcaccgagataggtcgcgttccctcccatctggcccaccgcacgcggaacgccctcgacaatctggtgatgctgcacaccagcgagcacgggggacgcgcttaccggcatgcagtcgaagaactcccggagaccatggagaccctgctgctccttggtctgatgatcctcctgactggcggggccatgcttttcctcatcagtggcaagggaatcgggaaaacctccatcggccttatctgcgtggtggcctccagtgggatgttatggatggccgacgttccgctccagtggattgcgagcgccatcgtgctggagttcttcatgatggtactgctcatccccgaaccggagaagcagagaacaccccaggacaaccagctggcctatgtagtgatcggcatcctgaccctggccgccatcgtcgcggctaacgagatgggtctgctggagacgaccaagcgggacctcggcatgtccaaggagcccggcgtcgtgagccccacctcctacttagatgtggacctgcacccggccagcgcctggaccctctatgcggtcgctaccaccgtcatcacgcccatgctgcgccacacgatagagaactccacggccaacgttagcctggccgcgatcgcgaaccaggcagtagtactcatggggctagataagggttggcccatctccaagatggacctgggcgtgcccctcctggccctgggctgctacagtcaggtcaatccactcaccttgaccgcagccgtgctgctcctggtaactcactacgcgatcattggccccgggcttcaagcaaaggccacacgggaagcgcaaaagcgcaccgcagcgggtatcatgaagaaccccaccgtcgacggcatcatgactatcgacctcgacccagtgatatacgactccaagtttgagaaacagttgggacaggtgatgctgctcgtcctatgcgccgtgcagttactcctgatgcggacaagctgggccttctgcgaggccctgacgttagcgaccggaccgatcaccacgctctgggagggctcccccggcaaattctggaacactaccatcgcggtcagcatggccaacatcttccgcggatcctatctggcgggcgccgggctggcgttttcgattatgaagagtgtcggtactgggaagcgaggcactgggagccagggggagaccctgggcgagaaatggaagaagaaactgaaccagttgagccgcaaagagttcgacctgtacaagaaatccgggataaccgaagtggacaggacagaggccaaggagggcctgaagcgcggggaaatcacacaccacgccgtgagccggggctccgcaaagctccaatggttcgtagagcgcaacatggtcatacccgaggggcgggtgatagacctggggtgtggccgaggaggctggagctattactgcgccggactgaagaaggtgacggaggtgcgaggatacaccaagggaggtccaggtcacgaggaaccggttcccatgtccacctacgggtggaatatcgtcaagctcatgtccggaaaggatgtgttctacctacccccagagaagtgcgacaccctgctgtgcgatataggtgagtctagcccgtcgcccacggtggaggagagccgcacaattcgggtcctcaaaatggtggaaccgtggctgaagaacaaccagttctgtatcaaggtgctaaacccctacatgccgaccgtgatcgagcacctcgagcggctacagcgcaagcacggcggcatgctggttcggaaccccttatcgcgaaactcaacccacgagatgtactggatctccaacgggacgggcaacatcgtgagttccgtcaacatggtgagccggctgcttctgaaccgcttcacgatgacccaccggcgaccgacgatcgagaaggacgtggacctcggggcgggcacgcggcacgtcaacgcagagcccgaaacacctaacatggatgtcatcggcgagcgcatccggcgcattaaggaggagcacagttccacctggcactacgacgacgagaacccctacaaaacctgggcttatcatgggtcctatgaggtcaaagcgacaggctcagccagcagcatgatcaacggtgtggtgaaacttctcaccaagccctgggatgtcgtgccgatggtcacgcagatggcaatgacagacacgactcccttcggccaacaacgggttttcaaggagaaggttgacacccgcactccccggcccatgccggggacccgcaaggtgatggagattaccgccgaatggctgtggcggacgctgggccgcaacaagcggcccaggctctgcactcgggaggagttcataaagaaggtcagaaccaacgcggccatgggcgcggttttcaccgaggagaaccagtgggacagcgcccgcgccgcagtcgaagatgaggagttctggaagctggtcgaccgggagcgcgaacttcacaagctcggaaagtgcggaagttgcgtctacaacatgatggggaagcgcgagaagaagttgggcgagtttgggaaggccaaaggcagcagggcgatatggtacatgtggctcggcgcacggtatctcgagttcgaggctctggggttcctgaacgaggaccactggttctcccgcgagaacagccactccggcgtggaaggggagggactccacaaactgggctacatcctgagagacatcagcaagatcccgggtggcgccatgtacgccgatgacacggcggggtgggacacccgcataacggaggacgacctccacaacgaggagaagataacccagcagatggaccctgagcaccggcagctggccaacgcgatcttcaagttaacctaccagaacaaggtcgtaaaggtacagcgcccgacccccaagggtactgttatggatatcatctcccggaaggatcagcgcgggagcggccaggtggggacttacgggctcaataccttcaccaatatggaggcccagctaatccggcagatggagggcgagggggtgctgagcaaagccgacctggaaaacccccacttactggagaagaaggtcacccaatggttagagacgaagggagttgagcgactgaagaggatggctatcagcggtgacgactgcgttgttaagcctatcgatgaccgcttcgccaacgccctgctcgcgctgaatgacatgggaaaggtccgtaaagacatccctcagtggcagccctccaagggctggcacgactggcagcaggtcccattctgtagccaccacttccacgaactgatcatgaaggacgggcgcaagctcgtcgtgccctgccgaccgcaggacgagctgatcggacgcgcccgtatcagtcagggtgcgggttggagcctgcgcgagacagcctgcctcgggaaggcctacgcacaaatgtgggcgctgatgtatttccaccggagggacctgcgactcgcctccaacgccatctgcagcgccgtgcccgtacactgggtgcccacctccagaaccacatggagcatacatgcccaccaccagtggatgaccacagaggatatgctgaccgtgtggaaccgcgtctggattgaggacaacccctggatggaggacaagacgccggtgacaacgtgggaagatgtaccctacctgggtaaacgggaggaccagtggtgcggcagcctgatcgggttaacgtcccgcgcgacgtgggctcagaacatcctgaccgccatccagcaggtccggagcctcattgggaacgaggagttcctagactacatgcccagtatgaaacgcttccggaaggaggaggagagcgagggggctatctggtag

SEQ ID NO: 26171 - RNA, 9873 nt, synthetic construct
  misc_feature 1..9873: note = derived and/or modified CDS sequence (opt11) from DENV-3__JQ920478__SS-prME
  source 1..9873: mol_type = other RNA
accagcctgtgcctcatgatgatgctgccagcgactttggccttccacctcaccagccgggacggggagccgagaatgattgtggggaagaatgaacggggcaagagtctgctgttcaagacagccagtgggattaacatgtgcacactcatcgccatggacttgggcgagatgtgcgacgacaccgtgacctacaaatgtcccttgataaccgaggtggagcccgaagacatcgactgctggtgcaaccttaccagcacctgggtgacctacgggacctgtaaccaagccggcgagcaccggcgcgacaagcggagtgtggcgctggcgccccacgtgggcatggggttagacacccgcacccagacgtggatgagcgcggaaggcgcctggcgccaggttgagaaggtggagacctgggcgttcagacaccccgggttcaccatcctcgccctgttcctcgcacactacatcgggacttctctcacgcagaaggtggtgatctttatactgctgatgctagttacgccttcgatgaccatgcggtgcgttggggtgggcaaccgagacttcgtcgaaggcctgtccggggcaacctgggtcgacgtcgttcttgagcacggcgggtgcgtgactaccatggccaagaataagcctacacttgacatcgaacttcagaaaaccgaggccacgcaactggccacactccggaagctgtgtatcgagggcaaaatcaccaacgttaccacggacagccgctgccccacgcagggcgaggcaatcctgcccgaggagcaggaccagaattacgtctgcaagcacacctatgttgaccgcgggtggggcaacgggtgtgggttgttcgggaagggctccctggtgacctgcgccaagtttcaatgcttagaaagcatcgagggcaaggctgtccagcacgaaaacctcaaatacacggtcattatcacggtgcacaccggtgaccagcaccaggtgggcaacgagacccagggggtgacggccgaaattacgccccaggcgtccacggtcgaagcgatcctgccggagtatggcaccctggggctcgaatgcagcccccggaccggcctggacttcaacgagatgatcctgttaacaatgaaaaacaaggcctggatggtgcaccggcagtggttcttcgacctccccctgccctggacttccggggccactaccgaaacgccaacttggaacaagaaggagcttctggtgaccttcaaaaatgcccacgccaaaaagcaggaggtagttgtgctggggtcccaggagggcgcgatgcacacggccctcaccggggcaaccgagatccaaaccagcagaggcaccagcatcttcgccggccatctgaagtgtcgtctgaaaatggacaagttagaattgaagggaatgtcctacgcaatgtgcctcaacgcgttcgtcctcaagaaggaggtaagcgagacgcaacacggaaccatcttgatcaaggtggagtacaagggggaagacgccccctgcaagattcccttcagcaccgaagacggccaggggaaagcccacaacggtcgcctgatcaccgccaacccaatcgtcacgaagaaggaggaacccgtgaacatcgaggccgagcccccgttcggcgagtcaaacatcgtgatagggatcggggataaggcgctgaaaatcaactggtacaagaagggcagctccatcggcaagatgttcgaggccacggcccgcggggcccgcagaatggcaatcctaggcgatactgcctgggacttcggcagcgtcgggggcgttctgaactccctggggaagatggtgcatcagatcttcggctcggcctacacggccctcttctccggggtctcgtggatcatgaaaattggcatcggagtgctgctgacgtggattgggctcaactccaaaaacacgagcatgtccttctcgtgcatcgtgatcggcatcatcaccctgtacctgggggccgtagtgcaagctgatatgggctgcgtgataaactggaaggggaaagagctcaagtgcggttccggcatattcgtcaccaacgaggtacacacatggaccgaacagtacaaattccaagccgattcgcccaagcgcctggccaccgccatcgccggggcgtgggagaacggtgtgtgtgggatccgctccacaacccggatggagaacctgctctggaaacagatcgccaacgagctgaactacatactgtgggagaataacatcaaacttaccatagtggtgggcgacgtaatcggggtgctagagcagggcaaacgcaccctgacgcctcagcccatggaactcaagtacagctggaagacttggggcaaggccaagatcgtgaccgctgagactcagaactcctctttcatcatcgatgggccgaacaccccagagtgcccttccgcgttgcgtgcctggaacgtgtgggaggtagaagactacggatttggcgtgttcacgaccaacatctggctaaagctccgggagaaatacacccagctctgcgaccaccggctgatgagcgccgctgtgaaggacgagcgagcagtccatgctgacatgggctactggatagagagccagaagaatgggtcctggaaattagagaaggccagcctaattgaggtgaagacctgcacctggcccaagtcccataccctgtggtccaacggggtgctcgagtccgatatgataataccgaagtcactggcgggcccaatctcgcaacacaactaccgacccggataccacacccagaccgcaggaccctggcacctggggaaattggagctggacttcaactactgcgagggaaccacagtcgtgatcaccgaaaactgcggcacgagggggccaagcctgaggaccacgacagtgtcgggcaagctcattcatgagtggtgctgccgatcctgcaccctgcccccgcttcggtacatgggggaggacggttgctggtatggtatggaaattcgcccgatcaatgagaaagaggagaatatggtcaagtccctcgtgagtgcgggatccggcaagaccgacaacttcacgatgggggttttatgccttgcgatcctctttgaagaggtaatgcgggggaagtttgggaagaagcacatgatcgccggcgccctgttcaccttcgtactgctcctctccgggcagatcacctggcgcgacatggcccacaccttgatcatgatcggctccaacgccagcgaccggatgggcatgggcgtaacgtatctcgcgctgatcgccacgttcaagatccagcccttcctggccctcggcttcttcttgcgaaaactgacgtcccgggagaatctcctactaggagtcgggcttgctatggctactacgctgcagctgccagaggatatcgagcagatggctaacggcatagccctcggcctcatggcattgaagctcatcacccaatttgagacctaccagttgtggacggccctgatcagcctaatgtgctccaatacaatattcaccctgaccgtggcgtggcgtaccgccacgctgatcctcgctgtgatttccctgctaccagtctgtcagtcatccagcatgcgtaagacagattggctcccgatgactgtagccgccatgggcgtaccacccttacccctgttcatcttctccctcaaggacacccttaagcgccgctcatggccactgaacgagggggtcatggctgtgggcctcgtctcaatcctggccagcagctttttgagaaacgatgtacctatggccgggcccctcgtggccggagggctgctcatcgcttgctacgtcatcacgggaaccagcgccgaccttaccgtggaaaaggccgccgacgtgacctgggaggaggaggccgagcagacaggtgtctcacacaacctcatgatcaccgtggacgacgacgggaccatgcgcatcaaagacgacgagaccgagaatatcctcaccgtgctgctgaagacggcccttctcattgtcagcggtatcttcccctactccataccagcgactctgctggtgtggcacacctggcagaagcaaacccagcggagcggggtgttatgggacgtccccagcccgcccgaaacgcagaaggccgagcttgaagagggggtctaccgtatcaaacagcagggtatcttcggtaagacccaggtgggcgtcggggtccagaaggagggcgtgttccacacgatgtggcacgtcacccgcggggccgtgctgacgcacaacgggaagcgcctcgagccgaactgggctaacgtgaagaaggacctgattagctatggcgggggctggaagctgtccgctcagtggcaaaagggagaagaggtgcaggtaatagccgtggagcccggcaaaaaccccaagaacttccagacgatgcccgggattttccagactaccacgggcgagatcggcgccatcgccctggacttcaagccggggaccagcgggagccccatcattaaccgggaggggaaagtcgtgggtctctatggcaacggggtagtgaccaagaacggcggatacgtgagcggcatagcgcagaccaacgcagagccggacgggcctacgcccgagcttgaagaagagatgttcaagaaacgaaacctgaccattatggacctccacccaggttccggcaagacccgtaagtatctccccgctatcgttcgcgaggctatcaaacggcgcctgcggaccctaatcctggccccgacgcgtgtcgtggcagcggagatggaggaagccctgaaggggctccccatccggtaccaaaccacagccaccaagtccgagcacacgggccgagagatagtggacctcatgtgccacgcgactttcactatgcggttactctctcccgttcgcgtccccaactataacctgatcgtgatggacgaagcccactttacagatccggcgtctatcgcagcacgggggtacatcagtacccgcgtcggaatgggtgaggccgcggcgatctttatgaccgccactcccccaggcaccgccgacgccttcccccagtccaacgctccgatccaagacgaggagagagacatccccgagcgaagctggaatagcgggaacgagtggatcacggacttcgccggaaagaccgtgtggttcgtgccaagcatcaaggccggcaatgacatcgctaactgcctgcgtaagaacggaaagaaggttattcagctttcccggaaaaccttcgacaccgaataccagaagaccaagctgaacgattgggatttcgtggtcaccacggacataagcgagatgggcgccaatttcaaagcagatcgcgttatcgacccccggaggtgcctgaagcccgtgatcctcactgacgggcccgaacgggtgatcctggcgggccccatgcccgtcacggtggcctccgccgcgcagcgtcgtggccgagtcgggagaaacagtcagaaagagaacgaccagtatatcttcacgggccaacccttgaacaatgacgaggatcacgctcattggaccgaagccaagatgttactggataacatcaataccccagaggggatcatccccgccctattcgagcccgagcgggagaagtccgccgctatcgacggcgagtaccgtctcaaaggggagagccgaaaaaccttcgttgagctgatgcggagaggcgacctgccggtgtggttagcccacaaagtggccagcgaaggtatcaagtatacggaccggaagtggtgcttcgatggggagcgcaacaatcagatcctggaggaaaacatggacgtagagatctggacgaaggagggagagaagaagaaactacggccccgctggctggacgcgcggacatactcagatccgcttgccctcaaggaatttaaggactttgctgccggtcgtaagtccattgcacttgacctggtgaccgagatcggaagggtccccagccacctggcccatcggactaggaatgccctcgacaacctggtgatgctccacacctctgagcacggcgggcgggcgtaccgccacgccgtggaggagttacctgagacgatggagacccttctcctcctgggcctgatgatcctccttaccggcggggccatgctgttcctcatcagcgggaaggggatcgggaagaccagcatcggtttgatctgcgtcgtggccagctcgggcatgctgtggatggctgacgtaccgctacagtggatcgcgtcggctatagtcctggagttcttcatgatggtgctgctaatccccgagcccgagaagcagcggacgccgcaggacaaccagttggcctacgtggttattgggatactaaccctcgcagccatcgtggcggccaacgaaatgggcttactcgagacgaccaagcgcgacttgggaatgtccaaggagcccggtgtggtctcccccacttcgtacctggatgtagatctgcacccggcctccgcctggaccctatacgctgtggcaacgacggtgatcacccccatgctacggcataccatcgagaacagcacagccaatgtgagtctggccgctatcgcaaaccaggccgtcgtcctcatgggccttgacaagggatggcccatctctaaaatggatctgggcgtgcctctcctggcgctggggtgctacagccaggtgaacccgctcaccctgaccgctgccgtcctgcttctggttacccactacgcgatcatcggcccggggctgcaagccaaagcgacgcgcgaggcacagaagaggactgccgcaggcatcatgaagaacccaaccgtggacggtatcatgaccatcgacttggaccccgtcatctacgactcgaagttcgagaagcagctgggccaggttatgctactcgtgctgtgcgccgtccagctgctcctaatgcgcacgtcctgggcattctgcgaggccctgacccttgcgaccggcccgattaccacgctgtgggaggggtccccaggcaagttctggaacaccaccatcgcggtgtccatggctaacatcttccggggcagctacctcgccggggcgggcctcgcgttctccatcatgaaatccgtggggaccggcaagcgcgggacgggatcccagggcgagaccttgggggagaagtggaagaagaagctgaaccaattgagtcgtaaagagttcgacctgtacaagaaatccggcatcaccgaggttgaccgaactgaagccaaggaaggtctgaaacggggcgagattacacaccacgccgtgtcccgtgggtccgccaagctccaatggttcgtggagcggaacatggtcatccctgagggccgcgtcatcgatctgggctgcgggagaggtggctggagttactactgcgccggcctgaagaaagtgacggaggtccgcgggtacaccaaaggcggcccggggcacgaggagcctgtgcccatgagcacctacgggtggaacattgtgaagctcatgtctgggaaggacgtgttctacctcccgcctgagaagtgcgacacgctgctgtgtgacataggagagagctccccgtcgcccacggtggaggagagtaggaccatacgcgtgctcaagatggtggaaccctggctgaagaacaaccagttttgtatcaaagtgttgaacccctatatgcccaccgtgatcgagcatctcgagcgcctgcagcggaagcatggagggatgcttgtccgcaaccccctcagccggaactctacccacgagatgtactggatcagcaacggcacggggaacatcgtgtcatctgtgaacatggtctcccgattgctgttaaataggttcaccatgacacaccgtcgccccacaatcgagaaggacgttgacctcggcgcggggacgcgccacgtgaatgcggagccagagacgccaaacatggacgtcataggcgagagaattaggcggatcaaggaagaacatagctccacctggcactacgacgacgaaaacccgtataagacctgggcctaccacggcagctacgaggtgaaggccactgggagcgccagcagcatgatcaatggcgtcgtaaaactgctgaccaagccctgggacctggtccccatggtgacacagatggcgatgaccgataccacgccctttgggcagcagcgagtgtttaaggagaaggtggacacccggacgccgcgacccatgccgggtactcggaaggtcatggagatcacggccgagtggttgtggcgcaccctcggacggaacaagcgccctcggctgtgtaccagggaagagttcatcaagaaggtgcgcacgaacgccgccatgggcgcggtgttcaccgaagagaaccagtgggactccgcacgtgctgccgtcgaagacgaagagttctggaagctggtagacagggagcgggagctccacaagctggggaaatgcgggtcgtgcgtttacaacatgatgggtaagagggagaaaaagctgggggaatttggcaaagccaaggggtcgagagcgatctggtacatgtggctcggggcccggtacctggagttcgaggccctgggctttctcaacgaggaccactggttcagccgagagaactcccactctggggtcgaaggcgagggactacataagctgggctatatcctcagggatatctccaagatcccgggcggcgccatgtatgccgacgacaccgcaggttgggatacccggatcacggaagacgacttgcacaatgaggagaagatcacacagcagatggaccccgagcaccgccaactggccaacgccatcttcaagctcacctaccagaacaaagttgtcaaggtccaacggccgacgcccaaagggacggtgatggacatcatctctcgcaaggaccagcggggctccggacaggtaggcacctacggtctcaatactttcaccaacatggaggcccaactgatccgccaaatggagggggagggtgtcctctcgaaggccgaccttgagaacccccacctcctggagaagaaggtcacacagtggctggagacgaagggggtagagcggctgaagcggatggcgatctccggcgacgactgtgtagtgaagcccatcgacgaccggttcgccaacgctctccttgccctaaatgacatgggtaaggtccgtaaggacattccgcagtggcagcccagcaagggatggcatgactggcagcaggttcctttctgttcccaccatttccacgagctcataatgaaggacggccggaagctggtggtaccctgccgtccacaggacgagctgatcgggagagcgcggattagccagggagcggggtggtccctccgggagacggcctgtttgggtaaggcctacgcccagatgtgggcattaatgtacttccaccggagagacctccgcctggctagcaatgccatctgctcggccgttccggttcactgggtgcccacctcgcgcaccacgtggagcatccacgcccaccaccagtggatgacgaccgaagacatgctgactgtctggaatcgtgtttggatcgaggacaacccctggatggaggacaagacgcccgtgaccacctgggaggacgtcccgtacctcgggaagcgcgaagatcagtggtgcggcagcctgatcgggctgacgtcgcgtgctacgtgggcccagaacattctcactgccatccagcaggtccgatccctgattggtaacgaggagtttctggactatatgcctagcatgaagaggttccggaaagaggaggagtccgagggcgcgatctggtaa

SEQ ID NO: 26172 - RNA, 9873 nt, synthetic construct
  misc_feature 1..9873: note = derived and/or modified CDS sequence (opt11) from DENV-3__JQ920480__SS-prME
  source 1..9873: mol_type = other RNA
accagcctgtgcctcatgatgatgttacctgccaccctggcctttcacctcaccagccgcgacggggagccacggatgatagtgggcaagaacgagcgcgggaaatcactgctattcaagaccgcgtcagggatcaacatgtgcaccctcatcgccatggatctgggggaaatgtgcgatgataccgtgacctacaagtgccctttgataaccgaggtggagcccgaggacatcgactgttggtgcaacctcaccagcacatgggtgacctacgggacctgcaaccaggccggcgagcaccggcgggacaagcggtccgtggccctggcgccgcacgtgggcatgggcctggacactcgcacccagacttggatgagcgcggagggcgcatggcggcaggtcgagaaggtcgagacctgggccttccgccaccccgggttcaccatcctcgccttgttccttgcgcactacatcggcacctccttgacgcagaaagtcgtgattttcatcctgctcatgctggtcacccccagcatgaccatgcggtgcgtgggggtgggaaaccgtgacttcgtagagggcttgtccggggccacctgggtggacgttgtccttgagcacggcgggtgtgtgacaaccatggccaaaaacaagcccaccctagacatcgagctgcaaaagaccgaggccactcaactggccacactccgaaagctttgtattgagggcaagatcactaacgtaaccacggacagccgctgtcccacccagggagaggcaatccttcccgaggagcaggaccagaactacgtctgtaaacacacctacgtggaccgggggtggggcaacgggtgcggcctcttcgggaagggctccctggtgacctgtgccaagtttcagtgcctggagagcatcgagggcaaggccgtccagcacgagaacctcaagtacacggtgatcattacagtgcacaccggggaccagcaccaagtgggcaacgagacccagggagtcacggccgagatcacgccccaggcctcaaccgtagaggcgatcctgccagactacggcactctggggctcgagtgctcacccaggaccggacttgacttcaacgaaatgatcctgctcacgatgaagaacaaagcctggatggtgcaccggcagtggttcctggacctgccgttgccctggacttccggcgccactaccgagacgccgacctggaacaagaaggagctcctggtgacattcaagaacgcccacgccaagaagcaggaggtcgtcgttctcggcagccaggagggcgcaatgcacacggccctgactggtgccactgaaatccagacctccggcgggaccagcatattcgccggccacctgaagtgccgcttgaagatggacaagctggaactgaagggaatgtcctacgcaatgtgcctcaatgcgtttgtcctgaagaaggaggtgtcagagacacagcacgggaccatcttaatcaaggtggagtataagggcgaggacgctccttgcaagatccctttcagcacggaagacgggcagggcaaggcccacaacggccggctgatcaccgcgaatcccatcgtaacgaagaaggaggagcccgtgaatatcgaggcggagccgccgttcggcgagtccaacatcgtcatcggcattggggacaaggccctgaagatcaactggtacaagaaggggagctccatcgggaagatgtttgaggctaccgcccgcggcgcccgtcgcatggctattctgggggacaccgcttgggatttcgggagcgtcggcggggtgttaaactccctcggcaaaatggtgcatcagatcttcgggagcgcctatacagccttattttccggcgtcagctggatcatgaaaataggcatcggggtgctactcacgtggatcggcctgaacagtaagaacaccagcatgtccttcagctgcattgttattggaatcatcaccctgtacctcggcgccgtcgtgcaggcggacatggggtgcgtgatcaactggaagggtaaagagctgaaatgcggttccggaatcttcgtcaccaacgaggtacacacctggaccgagcagtacaagttccaggccgacagtcccaagcggctggccacggccatcgccggtgcgtgggagaacggggtctgcggcattcgcagcaccacgcggatggagaacctcctgtggaaacaaatcgccaacgagctgaactacattctttgggagaacaacatcaagctgaccatcgtcgtgggggacgtgatcggcgtcctggagcagggcaagcggacactcacacctcagccgatggagctgaaatacagctggaagacgtgggggaaggccaagatcgtgaccgccgagacccagaacagcagcttcatcatcgacggcccgaacacccccgagtgcccttccgcgctgcgcgcctggaacgtgtgggaggttgaggactacgggttcggcgtgttcaccaccaacatctggctcaaactgcgggaaaaatacacacagctgtgcgaccaccgcctgatgagcgccgccgtgaaagatgaacgggccgtccacgcggacatgggctactggatcgagagccagaagaacgagtcctggaagctggaaaaggccagcctgatcgaggtaaagacatgcacctggcccaagtcccacacgttgtggagcaacggggttctggagtcggacatgatcattcccaagagcctggccggccccatctcccaacataactaccgccccgggtaccacacccagacggctggaccgtggcacctggggaagttggagctagacttcaactactgcgagggcaccacggtcgtcatcaccgagaactgtggcacccgggggccaagccttcgcaccacgaccgtgtccggcaagctgatccacgagtggtgctgccggagctgcaccctgccgcccctgcgttacatgggtgaggacggatgctggtacggcatggagatccggcctatcaacgagaaggaagagaacatggtcaagtccctggtgagcgccggcagtggcaagaccgacaacttcacgatgggggtcctgtgcctcgcgatcctgttcgaggaggtcatgagaggcaagttcggcaaaaagcacatgatcgccggcgccctgttcatgttcgtcctcctgctgagcgggcagatcacatggcgggacatggtgcacaccctaatcatgataggttcaaacgctagcgacaggatgggaatgggagtcacctacctggccctgatcgcaacgttcaagatacagcccttcctcgccctaggcttcttcctgaggaagctcacctcccgagagaacctgctgttgggcgtgggcttagccatggccaccacactgcagctccccgaggatatcgagcagatggcgaacggcatcgccctggggctgatggcgctcaagctgatcacgcagttcgaaacatatcagctatggactgccctcatctcactgatgtgcagcaacaccatcttcacgctgaccgtggcctggcggaccgcgacgcttatcctggccgtcatctccctgctccccgtgtgtcagagcagtagcatgcgcaagacggactggctgcctatgaccgtggccgccatgggcgtgccgcccctccccctctttatcttctcactgaaggataccctgaagcggcgctcctggccgctcaacgagggggtgatggccgttggcctagtgtccatcttggcgagctccttcttgcgcaacgacgtacccatggccgggccgctggtcgccggcggcttactaatcgcctgctatgtgatcaccggcacaagcgccgacctgacggtggaaaaggccgccgacgtcacctgggaagaggaagccgaacagaccggcgtgtcccacaacctgatgatcacggtggacgacgatgggaccatgaggatcaaggacgacgagaccgaaaacatccttaccgtgttgctgaagacagccttgctgatcgtgagtggcatcttcccctactcaatcccggccacgttgctcgtgtggcacacctggcagaagcagacacagcgcagcggggtactgtgggacgtgcccagccctcccgagacgcagaaggcggagctggaggagggcgtgtatcggatcaagcagcagggcatcttcgggaagacccaggtgggggtgggggttcagaaagagggcgtcttccataccatgtggcatgtgaccaggggagcggtgctaactcacaacggcaagcggctggagccgaactgggccaacgtcaagaaggatctgatcagctacggcggcgggtggaagctttccgcccagtggcagaagggggaggaggtccaggtcatcgcagtcgaaccagggaagaaccccaaaaactttcagactatgcccggcatctttcagaccaccaccggcgagatcggagccatcgccctagatttcaaaccggggacgtcaggctcccccatcatcaaccgcgaggggaaagtggtgggcctgtacggcaacggggttgtcacaaagaacggcgggtacgtgagcgggatcgcccagaccaacgccgagcccgacggcccgacccccgagctggaggaggagatgttcaagaagagaaacctgacgatcatggacctccaccccggcagcggaaagactcgtaagtatctgcctgcgatcgtccgggaagcaatcaagcgtcggctccgcaccctgatcctggctccgacccgtgtggtggccgccgagatggaggaagcgttgaaggggctgcccatccgctaccagacgaccgccaccaagagtgaacacaccggacgggagatcgtcgacctaatgtgccacgccacgtttaccatgcgcctactgtcaccagtgcgagttcccaactacaacctgatcgtcatggacgaggcccactttactgatcctgcttccattgcggcccgaggttacatcagcactcgcgtggggatgggggaagccgccgctatcttcatgacggccacgccgcccggcacggctgacgccttccctcagagtaacgccccgatccaagacgaggaacgcgacatcccggagaggagttggaacagcggtaacgagtggatcaccgacttcgctgggaagacggtgtggttcgtcccctccatcaaggccggcaacgacatcgccaactgcctccgcaagaacggcaaaaaggtcatccagctgtcgaggaagactttcgacaccgaataccagaagaccaagctgaacgactgggacttcgtggtcacgaccgacatcagcgagatgggcgcgaacttcaaggccgaccgggtgatcgacccgcgacgctgcctcaaaccggtgatccttaccgacgggcccgaacgcgtcattcttgcgggcccaatgcccgtgacggtcgcctccgccgcccagagaaggggccgggttgggcgcaacagccagaaggagaacgaccaatacatcttcacgggccagccgctcaacaacgacgaggaccacgcccactggaccgaggcaaaaatgctgttggacaacatcaacacgcctgagggaatcatccccgcgctcttcgagcccgaaagggaaaagtccgccgccatcgacggcgagtaccgcctgaagggggagagccggaaaactttcgtggagctgatgcgccgcggcgacctcccggtgtggctggcgcacaaggtcgccagtgagggtatcaagtacacggaccgcaaatggtgtttcgacggggagcggaacaaccagatactggaagagaacatggacgttgagatttggacgaaggaaggcgagaagaagaaactccgcccccggtggctagacgccagaacatactccgaccctctggccctcaaggagttcaaggacttcgccgcggggcggaagtcgatcgccctggacctggtcaccgagataggcagggtgccaagccatctcgcccatcgaacccgcaacgccctggacaatctagtgatgctccacacgtccgaacacggagggagggcctacaggcacgcggtcgaggagctgccggagaccatggagaccctgctcttgctgggcctcatgatcttactgaccgggggcgctatgctgttcctgatcagcgggaaaggcatcggaaagacgagcatagggttgatctgcgtggtggcctccagcggaatgctctggatggccgacgtccccctgcagtggatagcctccgcgattgttcttgagttcttcatgatggtgttgctgatccccgagccggagaagcagcgtacgccgcaggacaaccagctggcctatgtcgtgatcgggattctcactctggccgccatcgttgccgcgaacgagatgggcctgctcgagaccactaagcgggatctggggatgagcaaggaacccggagtcgtttcccccacaagctatttagacgtggacctccatccggcctccgcctggaccctgtacgccgtcgcgaccactgtgatcacacccatgctgcgccacaccatcgagaacagcaccgccaacgtgtccctcgctgcaatcgccaaccaagcggtggtgctgatgggcttagacaaggggtggcccatctccaagatggacctcggcgtgcccctgctggctctcgggtgctattcccaggtcaacccgctgaccctgaccgccgccgtgctcctgctggtgacccactacgcgataatcggtcccgggctccaagcgaaagccacccgggaggcccagaagcgcacagccgccggcatcatgaaaaaccccaccgtcgacggcatcatgacaatcgacctggatcccgtgatttatgacagcaagttcgagaagcagctgggccaggtgatgctccttgttctgtgcgcggtacagttattattgatgcggacctcctgggccttctgcgaggccttaactctagcaaccggcccgatcaccaccctgtgggaggggtcgccagggaagttctggaacacaaccatcgcagtgtccatggccaacatcttccgcggcagctaccttgccggggccggtttagccttcagtatcatgaagtccgtcggaactgggaagcgggggacaggctctcagggtgagactctgggagagaagtggaagaagaagctaaaccagctgtctcgcaaagagttcgacctgtataagaagtccggcatcacggaagtggacagaaccgaggcaaaagagggtctgaagcgcggcgagattactcatcacgctgtgtcccgggggagcgccaagctgcaatggttcgtggagcgtaacatggtgatccccgagggccgggtcatcgacttgggctgcggtcgcggcgggtggtcctattactgcgccggcctcaagaaggtcaccgaggtgcgggggtacacaaagggcgggcccgggcatgaggagcccgtgcccatgagcacctacggctggaacatcgtcaagctgatgtccgggaaggacgtcttctacctgccgcccgaaaagtgcgacaccctgctctgcgatatcggcgaaagctccccgtcgcccaccgtcgaggagtcccgcacgatccgggtcctgaagatggtcgagccctggctgaagaacaaccaattctgcatcaaggtgctcaacccctacatgccaaccgtcattgagcacttagagcgcctgcaacgcaagcacgggggcatgctcgtccggaaccccctgagccgaaattccacccacgagatgtactggatcagcaacggcaccgggaacatcgtaagctcagtcaacatggtgagtcggctgctcctgaaccgattcactatgacccatcggcgccccaccatagaaaaggatgtggacctgggcgccggaacccgacacgtcaacgcggagcccgagacgccgaacatggacgtaatcggcgagcgtatccgacggatcaaggaggagcattcgtccacgtggcactacgatgacgagaatccatacaagacatgggcttatcatggaagttacgaggtcaaggcgacagggtccgcctcgagcatgatcaacggcgttgtgaagctcctgacgaagccctgggacgtcgtgccgatggtgacccagatggccatgacagacaccacgccctttggacagcagcgggtctttaaggagaaggtggacacgagaacgccccgaccgatgccgggcacccgcaaggtgatggagatcaccgcggagtggctgtggcggaccctcgggcgtaacaagcggccgcgcttgtgcaccagggaggagttcatcaaaaaggtccgtaccaacgccgccatgggagccgtcttcactgaggagaaccaatgggattccgcgcgcgcagccgtggaagacgaggagttctggaagcttgtcgatcgggagcgtgaactccacaagctgggcaagtgtgggagctgcgtatacaacatgatgggcaagcgggagaagaagctgggggagttcggcaaggcaaaggggtcccgcgccatatggtacatgtggctcggcgcgcggtacttagaattcgaggccctgggctttctcaacgaggaccactggtttagccgcgagaatagccacagcggggtggaaggcgaggggttgcacaagctcggctacatcctccgggacatctccaagatccccgggggcgcgatgtacgccgacgacacagcgggatgggacacccgtatcaccgaagacgacttgcacaacgaggagaaaatcacacaacagatggaccccgagcaccgtcagcttgcgaatgccatattcaagctcacctaccagaacaaggttgtgaaggtgcagcgccctacccccaaggggaccgtcatggacatcatcagccggaaggaccagagaggctccggccaagtgggaacgtacggcctgaacacattcactaacatggaagcccagttgatccggcagatggagggggagggcgttctctctaaagccgacctggagaaccctcatctcctcgagaagaaagtcacccagtggctggagacaaagggtgtggagcggctgaagagaatggccatttccggcgacgactgtgtggtcaagcccatcgacgaccgcttcgcgaacgccctcctggccttgaacgacatggggaaggtaaggaaggacattccgcagtggcaaccctctaagggctggcatgattggcagcaggtccccttctgcagccaccactttcacgagctcatcatgaaggacggcaggaaactggtcgtcccctgccggccgcaggacgaactgatcgggcgcgcccggatcagccaaggcgccgggtggtccttgcgcgagacggcgtgcctgggcaaggcctacgcccagatgtgggccctgatgtacttccatagacgggacctccgcctggcgtccaacgctatttgctccgcagtccccgttcattgggtgcctacctcgcggaccacctggtccatccatgcccaccaccagtggatgacgaccgaggatatgctgaccgtgtggaatagggtctggatcgaggacaatccctggatggaagacaagaccccggtgaccacctgggaggacgtaccctacctcgggaagcgggaagaccagtggtgcggtagccttatcggcctgaccagccgagccacctgggcacagaacatcctcacggctatccagcaggtccggtcactgatcgggaacgaggagttcctggactacatgccaagcatgaaacgtttccggaaggaggaggaatcggagggcgccatctggtga

SEQ ID NO: 26173 - RNA, 9873 nt, synthetic construct
  misc_feature 1..9873: note = derived and/or modified CDS sequence (opt11) from DENV-3__JQ920479__SS-prME
  source 1..9873: mol_type = other RNA
acctccctgtgcctgatgatgatgctccccgccacactggcctttcatttgaccagccgggacggggagccccggatgatcgtggggaagaacgagaggggcaagagcctgctgttcaagaccgccagtggaatcaacatgtgcaccctcatcgctatggatctgggggagatgtgcgacgataccgtgacttacaagtgccccctgatcaccgaggtggagcccgaggacatcgactgctggtgcaacttaacaagcacctgggtgacgtatgggacatgcaaccaggccggcgagcaccgtcgcgacaagcgatccgtggccctggcgccccacgtaggcatggggctggacaccaggacgcagacgtggatgagcgcggagggcgcctggcggcaggtcgagaaagtggagacatgggcctttaggcatcccggcttcaccatcctcgccctgttcttagcgcactatatcggaacctccctgacgcagaaagttgtgatcttcatcttgcttatgctcgtaacccccagcatgaccatgcggtgtgtcggggttggcaaccgggacttcgtagaggggctttccggtgccacctgggtggacgtggtcctcgagcacggcgggtgcgtgacgacaatggccaagaataagcccacgttggacatcgagctgcagaagaccgaggccacgcaactggctaccctccggaagctgtgcatcgagggcaaaatcacaaacgtaaccactgacagcagatgccccacccagggcgaggcgatcttacccgaggagcaggaccagaactacgtctgcaagcacacgtatgtggaccggggttggggcaatgggtgcggcctattcggcaagggctcgttagtcacatgcgcgaaatttcagtgcctggaaagcatcgagggtaaggctgtccagcatgagaacttaaagtatacggtcatcatcaccgtgcacaccggggaccagcaccaggtcggcaacgagacccagggggtgacggctgagatcacgccccaggcgtccacggtagaggcgatcctgccggagtatggcaccctgggcctcgagtgcagcccccgtaccggactggacttcaatgagatgatcctgctcacgatgaaaaacaaggcatggatggtgcaccggcagtggtttctggacctgccgctcccgtggacaagtggcgccacaaccgagacccccacgtggaacaagaaagaactgctggtaaccttcaaaaacgcccatgccaagaagcaggaggtggtggtgctcggatcacaggagggcgcgatgcacaccgcgttaacgggggccaccgaaatccaaacctccggagggaccagcatcttcgctggccacctgaagtgccgtctcaagatggacaagctggaactgaagggtatgtcctacgccatgtgcctcaatgctttcgtcctgaagaaggaggtgagcgagacccagcacggaaccatcctgatcaaggtggagtacaagggcgaggacgccccctgcaagatcccgttctcaaccgaggacgggcaaggcaaggcccacaacggtcggttgatcaccgccaaccccattgtcacgaaaaaggaagaacctgtgaacatcgaggcggagcccccgtttggggagtccaacatcgtgatcggcattggagacaaggcactcaagatcaattggtataagaagggcagttccatcgggaaaatgttcgaggcaaccgccaggggcgctcggcgcatggcgatcctgggcgacaccgcctgggacttcgggtccgttggcggtgtattgaactccctcggaaagatggtgcatcagattttcgggtcggcctacaccgccctgttttccggcgtcagctggattatgaagatcggaatcggggtgttgctgacgtggatcggcctaaattctaagaacacctcaatgtccttcagctgtatcgtgatcgggatcatcaccctatacctcggcgccgtagtgcaagcggacatggggtgcgtaatcaactggaagggcaaagaactgaagtgcggttccgggatctttgtcaccaacgaggttcacacgtggaccgagcagtataaattccaggctgactccccaaagcggctggcaaccgcaatcgctggcgcgtgggaaaacggcgtgtgtggcatccgctccaccacccggatggagaacctcctgtggaagcaaattgctaacgagttgaactacattttatgggagaataacatcaagctgaccatagtcgtgggggacgtgatcggcgtcctggagcagggcaagagaactctcactccccagcccatggagttgaaatacagttggaaaacgtgggggaaggccaaaatcgtgaccgccgagacccaaaactccagcttcatcatcgatggcccgaatacccccgagtgcccctctgcgctgcgcgcatggaacgtgtgggaggttgaagattacgggttcggcgtttttacgaccaacatctggcttaagttgcgagaaaaatacacccagctgtgcgaccaccgcctcatgagcgccgctgtgaaggacgagcgggccgtccatgcggacatgggctactggatcgaatctcagaagaacgagtcctggaagctggagaaggcttcactgatcgaggtgaagacctgtacctggccgaagtcccacactctctggagcaacggggtactggagtccgacatgataatccctaagagcctggccggccccatctcccagcataattaccgtcccggctaccacacccagaccgccggtccgtggcatctcgggaagctcgagctggactttaactactgcgagggtaccactgtcgtgattactgagaattgcggcatccgggggcccagcctccgcaccaccacggtttccggcaaactgatccacgaatggtgctgccggagttgtaccctacctcccctgcgctacatgggggaggacggctgctggtatgggatggagatccggccgatcaatgagaaggaggagaatatggttaagtccctagtcagcgccgggagcggcaagaccgataacttcaccatgggggtgctttgcctcgcgatcctgttcgaggaggtgatgcgcggcaagttcggaaagaagcacatgatagccggggctctgtttatgtttgtgctcctgctgagcggacagatcacgtggcgggacatggtgcacaccctcatcatgattggctccaacgccagcgaccggatgggcatgggggtaacataccttgctctaatcgcgaccttcaaaatccagcccttcctcgccctggggttcttcctacggaaactcacgtcccgtgagaacctactgctgggggtgggcctggccatggccaccacccttcaactccccgaagacattgagcagatggcaaacggcatagccttagggctgatggccctcaagttgatcacgcagttcgagacgtaccagttgtggacagccctcatctcgctgatgtgcagcaatacgatcttcaccctgacggttgcctggcggaccgcgaccctcattctcgccgtgatctccctgttacccgtctgccagagttcgagcatgcgtaagaccgactggctaccgatgactgtggccgccatgggcgtgccgccactccccctctttatattctcactgaaggacaccctgaaacggagaagctggccgctgaacgagggggtcatggccgtaggtctggtgtccatcctggcgagctccttcttgcgcaatgacgtgcccatggccgggcccctagttgccggcggcctactgatcgcatgctacgtgatcaccgggaccagcgccgacctaacggtggaaaaagcggccgatgtaacctgggaggaggaagccgaacagaccggcgtgtcccacaacctgatgataaccgtggacgatgatgggacgatgagaatcaaggacgacgagaccgagaacattctcacagtgctgctgaagacagccctcctgatcgtgagcggaatcttcccctactcaatccccgccaccctgttagtgtggcatacgtggcagaagcaaacacagcgcagcggagtcttatgggacgtgcccagtccgcccgagactcaaaaggctgagctggaggaaggcgtgtatcggattaagcaacagggtatcttcgggaagacccaggtcggcgtgggggttcagaaggaaggcgtatttcacacgatgtggcatgtgacccgcggggccgtgctaacccacaatgggaagaggttagaaccgaactgggccaacgtcaagaaggacctgattagctacggcgggggctggaagctatccgctcagtggcagaagggggaggaggtacaggttatcgctgttgagccaggcaagaaccccaagaacttccaaaccatgcccgggatcttccaaacgacaaccggcgaaattggcgccatagctctcgatttcaagccgggcaccagcggctcgcccatcatcaaccgcgaggggaaggtggtgggcctgtacggcaacggggtcgtgacgaaaaacggcggttacgtgtccggcatcgcccagaccaacgccgagccagacgggccgaccccggaactggaagaggaaatgttcaaaaagaggaacctcacgataatggatctgcaccccggcagtggtaagacacgtaagtacttacctgcgatcgtccgggaggccataaagcgccggttacgcaccctgatcctcgccccaacccgggtggtggcggccgagatggaggaggcgctcaagggcctgcccatccgctaccaaaccacggccacaaagagcgagcataccggccgggagatcgtcgatctgatgtgccacgcgaccttcacgatgcgactcctgtctcccgtccgggtacccaactacaacctgatcgtcatggacgaagctcactttaccgacccggcgtccatcgcggctcgcgggtacatctcgacccgggtgggaatgggtgaagccgccgcgatattcatgacggccactccgccgggcaccgccgacgccttcccccagagtaacgcccctatccaggacgaggagagggacattcccgagcggtcgtggaactccggcaacgagtggatcactgacttcgctgggaagacggtgtggttcgtcccaagcatcaaggccggcaatgacatcgcgaactgcctacgcaagaacggaaagaaggttattcaactgtcacgcaagacgtttgacaccgaataccagaagaccaagttgaacgactgggactttgtggtcacaacagacatcagcgagatgggagccaatttcaaggcagatcgggtgatcgacccacgtaggtgcctcaagccggttatcctgaccgacgggcccgagcgcgtcattctggcggggcccatgcccgttaccgtggcctccgccgcccagcggcgcggccgagtcgggcgtaacagccaaaaggagaacgaccaatatatcttcaccggccagccgctcaacaacgacgaggatcacgcccactggacggaggcgaaaatgcttttggacaacatcaacacacccgagggcatcatccccgcactcttcgaacccgagcgagagaagagtgctgctatcgacggcgagtatcgcctgaaaggggaaagccggaagaccttcgtggaactgatgaggcggggtgatctcccggtgtggttggcgcacaaagttgcgtccgagggcatcaagtacaccgatcgcaagtggtgcttcgacggggaacggaacaaccagatcctcgaggagaacatggacgtggagatttggacgaaggagggcgagaagaagaagctccgcccccgatggcttgatgcccgcacgtactctgatcccctggccctcaaggagttcaaggatttcgctgcgggccggaagtccatcgccctggacctcgttaccgagatcggccgtgttcccagccacctcgcgcaccgcacccggaacgcattggataatctggtgatgctgcacactagcgaacacggcggtcgcgcctaccggcacgccgtagaggagctgccggagacgatggagacactgctcctgctgggtctcatgatcttactcaccgggggcgccatgctgtttctcatttctgggaagggcattggcaagacaagcatcggactgatctgcgtggtggcctccagcggcatgctgtggatggccgacgttcctctgcagtggatcgcgagcgccatcgtgctggagttcttcatgatggtgctgctgattcccgagccggagaagcagcgcacgccccaggacaatcagctggcttacgtagtgattgggatccttaccctagccgccatcgtggccgcgaacgagatgggtctgctcgagacgaccaagcgggacctggggatgagcaaggagccgggcgtcgtgagtcccacgagctacctggacgtagacctccatccggcctccgcctggaccttgtacgccgtcgcgaccaccgttattacccccatgctccgccacaccatcgaaaacagcaccgcgaacgtgtccctagccgctatagccaaccaggccgttgtgctcatgggcctggataaagggtggcccattagcaagatggacctaggagtgccgctgctggctctcggctgctactctcaggtcaacccgctgaccctgacggccgccgtgctcctgctggtgacccactacgccatcatcggccctgggctccaggcgaaagccacccgggaggcccagaagcgtaccgccgccggcatcatgaagaacccgacggtcgacggcatcatgacaatcgatttggaccctgtgatctacgacagtaaattcgagaagcagttgggccaggttatgctcttagtcctgtgcgcggtgcagctcctactgatgcggacttcgtgggccttctgcgaggccctcaccctggccacgggcccgataaccaccttatgggaagggagcccgggaaaattctggaataccacgattgcggtgtccatggcaaacatcttccgcggcagctacctcgctggcgccggattagccttttccatcatgaagtccgtcgggaccggcaagcgggggactggctcccaaggcgagactttaggtgagaagtggaagaagaaactcaaccagctgtctcgcaaggagttcgacctgtacaagaaatccggcatcacggaggtggatcggacggaggcgaaggagggtctcaagaggggcgagatcacccaccacgctgtatcccgggggagcgcgaagctgcagtggttcgtcgagaggaatatggttatccccgagggccgcgtgatcgacctgggctgtggacgcggtggatggtcctactacagcgcagggctgaagaaagtcaccgaggtgcggggctataccaaaggcgggcccgggcacgaagaaccggtgcccatgtccacgtacgggtggaacatcgtcaaactgatgagcggaaaggacgtgttctacctaccacccgagaagtgtgataccctgctctgcgacatcggcgagtcgagccccagccccaccgtggaggaaagccgcaccatccgagtcctgaagatggtggagccctggctgaaaaacaaccagttctgcatcaaggtgctcaacccctacatgccgacggtcatcgagcacctggagcgcctgcagcgtaagcatgggggcatgctcgtgcggaaccccttatccagaaattccacccacgaaatgtactggatctccaacggaaccggtaacatcgtgtcgtccgttaacatggtcagccggctgctcttgaaccgcttcaccatgacacacagacgtcccacgatcgaaaaggacgtcgacctgggcgctgggactcggcacgtcaacgcggagcccgagaccccgaacatggatgtgatcggcgagcgcatccggcggatcaaggaggagcactccagcacgtggcactacgatgacgagaacccctacaagacctgggcctaccacggctcctacgaggtcaaggccacgggaagcgccagctccatgataaatggcgtggtgaaacttttgacaaagccctgggacgtcgtgcctatggttacgcagatggctatgaccgacaccacacccttcgggcagcagcgagtcttcaaggagaaggtggatacgcgcacgcctcggcccatgccgggaacccgcaaggtgatggagattaccgctgagtggctgtggcggacgcttggtcgcaacaagcgcccccgcctgtgcaccagagaggagttcatcaaaaaggtcaggacaaacgccgcaatgggggccgtgtttaccgaggagaaccagtgggacagtgcacgcgccgcagtcgaggacgaggagttctggaagctggtcgatcgggagcgcgagctccataagctgggcaagtgcggttcctgcgtttacaacatgatgggcaagagggagaagaagctcggcgagtttggcaaggccaaggggagccgcgccatatggtacatgtggctcggagcgcggtacctggagttcgaggccctgggcttcctcaacgaggaccactggttctctcgcgagaacagccacagcggggtggagggggagggactccacaagctgggctacattctccgggatataagcaagatacccgggggcgccatgtacgccgacgacacagccggctgggatacccgtatcaccgaggatgatctgcacaatgaagagaagatcacccaacagatggaccctgagcaccggcaattagcgaacgctatcttcaaactcacgtatcagaacaaggtcgtgaaagtgcagcgcccgacccctaagggaaccgtcatggacataatctcgcggaaggaccagagaggatccggccaagtgggcacctacggcctcaacacgttcaccaacatggaggcccagctgatccggcagatggagggggaaggcgtgttgtccaaggccgacctggagaacccccacctcctcgagaagaaagtcacccagtggctagagaccaagggggtcgagcgcctgaagcggatggctatcagcggcgacgactgcgtggttaagccaatcgacgacaggttcgccaacgccctcctcgccctgaacgacatggggaaggtgcggaaggacatcccgcaatggcagccctccaagggctggcacgactggcagcaggtccccttctgttcgcaccacttccacgaactcatcatgaaagacgggcgcaaattagtagtgccgtgccggccccaggacgagctgatcggacgcgcccggatatcccagggcgccgggtggtcgctccgcgagacggcatgcctgggaaaagcctacgcccagatgtgggcactgatgtacttccaccgccgggacctccgactggcgtccaatgccatctgcagcgccgtgcccgtccactgggtgcccacgtcccgtaccacttggagcatccacgcccaccaccagtggatgaccacggaggatatgctgacagtgtggaaccgcgtctggatagaggacaacccctggatggaggacaagaccccggtaaccacgtgggaggatgtgccctacttgggtaagagagaggatcagtggtgcggcagcctgatcggcctgacctctagagccacctgggcccagaacatcctaaccgccatccagcaggtccggagcctgatcggcaacgaggagttcctggactacatgccatctatgaagcgcttcagaaaagaggaagagagcgagggcgcaatatggtga

SEQ ID NO: 26174 - RNA, 9873 nt, synthetic construct
  misc_feature 1..9873: note = derived and/or modified CDS sequence (opt11) from DENV-3__KU216208__SS-prME
  source 1..9873: mol_type = other RNA
acgagcctgtgcctcatgatgatcctgcccgcggctctggcgttccacctcaccagccgtgatggggaaccgcggatgatcgtggggaaaaacgaaaggggcaagagcctgctgtttaagaccgcctccgggatcaacatgtgcaccttaatcgccatggacctgggcgaaatgtgcgacgacaccgtgacctacaagtgccctcatatcacagaagtggaacccgaggacatcgactgctggtgcaacctgactagcacctgggtcacctacggcacgtgcaaccaggccggcgaacaccggcgcgacaagcggtccgtggccctcgcgccccatgtgggcatggggttagacacccgcacccagacctggatgtcggcagagggcgcctggcgccaggtggagaaggtggagacgtgggccttacgccacccggggttcaccatcctcgcgttattcctagcccactacatcgggacctctctcacacagaaagtcgtgatcttcatactgctgatgctcgtcaccccaagcatgaccatgcggtgcgtgggggtgggcaatcgcgatttcgtcgagggattatccggggccacatggatcgatgttgtgctggagcacggcgggtgcgtcaccacgatggccaagaataagccgaccctcgatatcgagttacagaagaccgaggccacacaattagctacactccggaagctgtgcatcgagggaaagataaccaatatcaccaccgactcccgctgccccactcagggcgaggccgttctgccggaggaacaggaccagaactacgtgtgcaagcacgcttatgttgaccgggggtggggtaacgggtgcggcctcttcggcaagggatccctggttacgtgcgccaagttccagtgcttggaacccatcgagggcaaggtagtacagtatgagaatttgaagtacacggtgataattaccgtgcacacgggggaccagcaccaggtcggtaacgagacgcagggggtgaccgccgagatcacgccccaggcgagcacgaccgaagccattctgcctgagtacggcaccctagggctcgagtgctccccgcgcaccggcctggacttcaatgaaatgatcctgctgaccatgaagaataaggcctggatggtccaccggcagtggtttttcgacctgcccctgccctggacgagcggcgccaccaccgaaacccccacgtggaaccgcaaggagcttctggttacgttcaagaacgctcacgcaaagaagcaagaggtggtcgtccttggctcccaggagggggccatgcacaccgctcttaccggtgccacggagatccagaactcaggaggcacctccatcttcgccggtcatctaaagtgccgtctgaaaatggacaaactcgagctgaagggaatgagctacgcgatgtgcaccaacacttttgtgctgaagaaggaggtttccgaaacgcagcacgggaccattctaatcaaggtggagtataagggcgaggacgccccatgtaagatccccttcagcaccgaagacggccagggcaaggcgcacaacggccgcctgataacggccaacccagtggtcacgaagaaggaggagcccgtgaacatcgaagcggagcctcccttcggggagagcaacatcgttatcggtatcggggacaatgcactgaagattaattggtacaagaagggctccagcatcgggaagatgttcgaggccaccgcccgaggcgcccgcaggatggctatccttggcgacaccgcctgggacttcgggtccgtcggcggagtgttaaacagcctgggcaaaatggttcaccaaatcttcgggtccgcctataccgccctgttcagtggcgtctcctgggtcatgaagatcggcatcggtgtactcctgacgtggattggcctgaactctaaaaacaccagtatgagcttctcctgcatcgctatcggaatcatcactctatacctgggcgcggtcgtgcaggccgacatggggtgcgtggtcaactggaagggaaaggagctgaagtgcggcagcgggattttcgttactaatgaagtgcacacatggaccgagcaatacaagttccaagccgactccccgaagcgcctggcaaccgccatcgccggcgcctgggagaacggagtctgcggcatccgcagcaccacgcggatggagaacctgctgtggaagcagatcgcaaacgaactcaattacattctgtgggagaacaacatcaaactgacagtcgtggtcggagacaccatcggcgtgctagagcaaggcaagcgcaccttaacgccccagccgatggagctaaagtactcctggaagacctggggaaaagccaagattgttaccgcggagacccagaactcctccttcatcattgatggtcctaacacgcccgagtgtccgagcgcctcccgggcatggaatgtctgggaggtggaggattacgggttcggagttttcacgaccaacatctggctcaagttaagagaagtctacacccagatgtgcgaccaccgtctgatgtcggcggcggtgaaggacgagagagcggttcacgcagacatgggatactggatagagagccagaagaacggttcctggaagctcgagaaagcaagccttatcgaggtcaagacctgtacgtggccgaagtctcacacactgtggtcaaacggcgtgctcgagtcagacatgatcatcccgaaatccttggccgggcccattagccagcacaactaccggcccggttatcacacccagacagcgggcccctggcacttgggcaagctcgagcttgactttaactattgcgagggcacgaccgtggtcattaccgagaactgcggcacccgtggccccagcttgcggactaccaccgtaagcgggaaactcatccacgaatggtgctgccgcagctgcaccctgcccccgttacggtacatgggcgaggacggctgctggtacggcatggaaattcgccccatctctgagaaggaggagaatatggtgaaaagcctcgtctccgcgggcagcgggaaggtggacaacttcacgatgggggtgctatgcctggctatcctttttgaagaggtcatgcgggggaagttcggcaagaagcacatgatcgcgggtgtgttcttcaccttcgtgcttctgctctccggccagatcacctggcgcgacatggctcacaccctgatcatgataggtagcaatgcctccgaccgcatgggcatgggagttacgtacctggcgcttatcgcgacctttaagattcagcccttcctagccctggggttctttctcaggaagctaaccagccgggagaacctgctactgggtgtcggactggccatggcgaccactctccagcttccggaggacatcgagcagatggccaacgggatcgcgctgggcctcatggccttaaaattgatcacgcagttcgagacctaccaactctggacggccctgatctcactgacgtgctcgaatacgatcttcacactcaccgtggcgtggcgcacagcaaccctgatcttagccggagtcagcctcctgcccgtatgccagtccagctccatgagaaagaccgactggctgccaatgaccgtggcagccatgggcgtcccacccttaccgctgttcatcttcagtcttaaggacactctcaagcgccgctcctggcccttgaacgagggtgtgatggcggtcggcctcgtgtctatcctcgcctcaagcctactgcggaacgacgtccccatggccggaccgctcgtcgcagggggcctcttaatagcgtgctacgtgataaccggtacctccgcggacctcaccgttgagaaggcagccgacgttacgtgggaggaagaggctgagcagaccggcgtgtcccataacctgatgataaccgtggacgacgacgggaccatgaggatcaaggacgatgagacagagaacattctgactgtcctgttgaaaaccgccctgcttatagtgtccggcatctttccgtacagcatacccgcgaccttactggtctggcacacctggcagaagcagacgcagcggtccggggtcctctgggacgtgccaagtccgcccgagacccagaaggccgaactggaggagggcgtgtaccgcatcaagcagcaggggatccttgggaagacacaagtgggggtcggagtgcaaaaagagggcgtgttccacaccatgtggcacgtgacgcggggcgcagttttaacccataatggaaagagactggagcctaactgggcctccgtcaagaaagatttgatcagctacggcgggggttggcggctctccgctcagtggcagaagggggaggaggtccaggtgatcgcagtcgagcccggcaagaaccccaagaacttccagaccatgcccggcacattccagacgaccaccggggagatcggcgccatcgccctggacttcaaacccggtacctcaggcagccctatcattaaccgcgagggcaaggtcgtggggctgtacggcaacggtgtggtgacgaagaatggcgggtatgtatccggcatcgcccagaccaacgcggagccggatggcccaacccccgaactcgaggaagagatgttcaagaagcggaaccttaccatcatggacctacaccccgggagcgggaaaacgcggaagtacctgcctgccatcgtccgggaggccatcaaacgccggctccgcaccttgatcctggccccaacccgggtggttgccgctgagatggaggaggcgcttaaggggctgcctattcgataccagaccacggccacgaagtccgagcacacgggccgtgaaatcgtcgacctgatgtgccacgccacctttacgatgcgtcttcttagccctgtgcgcgtgccgaattacaacctgatcattatggacgaggcccattttaccgaccccgcgtccattgccgcccgcgggtacatctcgacccgggtgggtatgggcgaggccgctgccatcttcatgaccgccacgccgccggggaccgccgacgccttcccgcagtccaatgcgcccatccaggacgaggagcgcgacatccccgagcgtagctggaactccggcaacgagtggataactgacttcgctgggaagaccgtatggttcgtgccctcaatcaaggccggtaacgacatcgccaattgcctccgcaagaacgggaagaaagttatccagctgtcccgcaagacgttcgagacggagtaccagaagaccaagctgaacgactgggactttgtggtgaccacggacatcagcgaaatgggcgccaacttcaaggcggaccgggtcatcgatccgcgccggtgtctcaaacccgtgattcttacggatggccctgagcgcgtgattctagccgggcccatgcctgtcacagccgcgtccgccgcgcaaagacgcggacgggtgggacgcaacccccaaaaggagaatgatcaatacatcttcacaggccagcccctcaacaacgacgaagaccacgcccactggaccgaggccaaaatgcttctcgataacatcaacacacccgaagggatcatccccgccctattcgaacccgaacgagagaagagtgcggcgatcgacggcgagtaccgcctgaagggcgagagtcggaagaccttcgtggaattaatgcgccgcggcgacctccccgtctggctagcctacaaggtggccagcgagggcatcaagtacactgaccgcaagtggtgtttcgacggccagcggaataaccagatcctggaggagaacatggatgttgaaatctggactaaagagggagagaagaagaagctccgcccccggtggctggacgcccgcacgtactcggacccgctggcgctcaaggagttcaaggactttgccgccggtcgcaagagtatcgccctggatctggtgaccgagatcgggcgggtcccctcccatcttgcccacaggacccgcaacgcgctagacaacttggtcatgctccataccagcgagcatggcgggcgcgcctatcggcatgccgtggaggagcttcccgagacaatggagaccctgctcctgctgggcctcatgatcctcctgaccgggggcgcgatgctgttcctgatcagcggtaaggggatcggcaagacatccatcgggctgatctgtgtgatagccagctccggcatgctctggatggctgagataccgctgcagtggatcgcctcggcaatcgtgctcgagttcttcatgatggtgctcctgatccccgagccggagaagcagcgcacgcctcaggacaatcagcttgcgtatgtggtcatcgggatcctcacccttgccgcgatcatcgccgccaacgagatggggctgctcgaaactaccaagcgggacctgggtatgtccaaggagccgggggtggtgagccccacgagttatctggacgttgacctccaccctgcctcagcatggaccctgtacgccgtagcaaccaccgtgatcacgcccatgctgcgtcacaccatcgagaacagcacggccaatgtcagcctcgctgcgatcgcgaatcaagccgtggtgctgatgggactggacaagggttggcccatctccaaaatggacctgggcgtccccctgttagccctcgggtgctacagccaagtgaaccccctgaccttaactgccgcggtgctcctgctgatcacccattacgcaataatcggccccggccttcaggccaaggccacccgggaggctcagaagcgcaccgctgcggggattatgaaaaacccgacggtcgacggcatcatcaccatagacctggacccggtgatatacgattccaaattcgagaagcagctcggccaggtgatgctcctggtcctatgcgccgtgcagctcctgctgatgcggaccagctgggccctctgcgaagcgcttacgctagccacgggccccatcaccactctgtgggagggcagccccgggaagttctggaacacaacgatcgcggtcagcatggctaacatctttaggggctcctacctggccggggcgggcctggccttttcaatcatgaagtcagtcgggaccggcaagcggggaaccgggagccagggagaaaccctcggggagaagtggaagaagaaactgaaccagctgagcaggaaagagttcgacctctacaagaaatccggcattaccgaggtcgaccggacggaggcgaaggaggggctgaagaggggcgagaccacccaccacgccgtgagccggggaagcgctaagctgcagtggttcgtcgagcgcaacatggtgatcccggagggtcgggttatcgacctaggctgcggtcgtggcgggtggagctactattgcgcgggcttgaagaaggtcaccgaggtgcggggttacaccaagggcgggcccgggcacgaggaaccggtgcccatggccacctacggctggaatatagttaaactcatgtcagggaaggatgtgttctacctaccgccggagaagtgcgacaccctcctgtgcgacattggtgagagctccccaagccccacagtggaagaatcccgcacgatccgcgtactaaagatggtagagccgtggctcaagaacaaccagttctgcatcaaagtgctgaacccctacatgccagccgtcatcgaacacctggagcgtctccagcgcaagcatggcggcatgctggtgcggaaccccctgagccgcaactccacgcatgagatgtactggatcagtaacggcaccggcaatattgtgtcctcagtcaacatggtgtcccggttactactgaaccggttcacgatgacacaccggcgcccaaccatcgagaaggacgtggacctcggcgccggcacccggcacgtcaatgctgagcccgagacccccaacatggacgtgatcggggagcgcatcaagcggatcaaagaggagcataacagcacttggcactacgacgatgagaacccgtacaagacatgggcgtatcacggatcatacgaggtcaaggccaccgggagcgcctcgagcatgatcaacggcgtcgttaagctgctgacgaaaccatgggacgttgtgcctatggtgacacagatggccatgaccgacaccaccccgttcgggcaacagagggtcttcaaagaaaaggtggacactcggaccccgcgccctatgcccggcaccaggaaagtgatggaaataaccgcggaatggctctggcgcacgctaggccggaacaaacgcccgcggctgtgtacccgcgaggagttcaccaagaaggttagaaccaacgccgccatgggggcagtgtttacggaagagaaccagtgggacagtgctaaggcggccgtggaagatgaggagttctggaagctcgtcgatcgggagcgcgagctacacaagctgggcaagtgcggatcatgtgtgtacaacatgatggggaagagggagaaaaagctcggggagttcggtaaggccaaaggcagccgggccatttggtacatgtggctgggggctcggtacctggagttcgaggcgctaggattcctgaatgaagaccactggttttcccgcgagaacagctactccggcgtcgaaggcgaagggttacacaagctcggttacatcctgcgggacatcagcaagatcccgggcggggccatgtatgccgacgataccgccggctgggacacccggatcaccgaggacgacctgcacaacgaggagaagatcacgcagcagatggatcccgagcatcggttactggctaacgcgatattcaagctgacctaccaaaacaaggtcgtgaaggtgcaacgacccacgccgacggggaccgttatggacatcatatcccggaaggaccagcgcggtagcggacaggtggggacgtacggcctcaacacttttactaacatggaggcccagctcgttcgacaaatggagggggagggtgtcctgtccaaggccgacctcgagaacccacacctcccggagaagaagattacccagtggcttgagacgaagggggtggaacgcttgaagcggatggccataagcggcgacgactgcgtggtcaaacccatcgacgacaggttcgccaacgcgctcctggccctcaacgacatgggcaaggtgagaaaagacataccccagtggcaaccgtctaaagggtggcacgactggcagcaggtccccttctgcagccaccacttccacgaacttatcatgaaggacggccgcaagctagtagtcccctgccggccccaggacgagctcatcggtcgcgcccgtataagtcaaggcgccgggtggagcctgcgagagactgcgtgtctaggcaaggcctacgcccagatgtggtccctcatgtactttcacagacgagacctgcgccttgccagcaacgccatttgcagtgcggtgccggtccactgggtacctaccagccggaccacgtggtcgatccacgcacaccaccagtggatgaccacggaggacatgctcaccgtgtggaaccgcgtctggatcgaggacaacccctggatggaggataagacgcccgtgaccacatgggagaatgtgccttacctgggcaaacgggaagaccagtggtgcggctcgctaatcggcttgacctcacgcgccacgtgggcccaaaacattccaaccgccatccagcaggtccggtcgctgatagggaacgaggagttcttggactacatgcccagcatgaagcggttccggaaggaggaggagtccgagggcgcgatctggtga

SEQ ID NO: 26175 - RNA, 9873 nt, synthetic construct
  misc_feature 1..9873: note = derived and/or modified CDS sequence (opt11) from DENV-3__GU370053__SS-prME
  source 1..9873: mol_type = other RNA
acaagcctctgcctcatgatgatcctgcccgccgctctggcgttccacctcacaagccgggacggggaaccccgaatgatcgtgggtaagaacgagcgaggaaagagcctgcttttcaaaacggcctccgggatcaacatgtgcaccctcatagccatggatctgggcgaaatgtgcgatgacaccgtgacctacaagtgcccccacatcacggaggttgagcccgaggacatagactgctggtgcaacctgacgagtacgtgggttacctacgggacgtgcaatcaggccggcgagcaccgacgcgacaagaggagtgtcgctctcgcgccccacgtgggtatgggtcttgacacccgcacccagacctggatgtccgccgagggcgcctggcgccaggtggagaaagttgagacgtgggccctgcggcatccggggttcaccatcctcgctctgttcctagcccactacatcggcacctccctcacccagaaggtggttatcttcatcctgctgatgttagtcacgcccagcatgaccatgaggtgcgtgggggtgggcaaccgcgacttcgtcgagggcctgagcggggctacctgggtggacgtggtgctggagcacgggggatgcgtgactacgatggccaagaacaagcctaccctcgacatcgaactccagaaaacggaggccacccagctggcgactctccggaagttgtgcatagagggcaaaatcaccaacatcaccaccgatagccgctgcccgacgcagggcgaggccgtgctgccggaggagcaagaccagaactatgtgtgtaagcacacctacgtggacagaggttggggcaatgggtgcggcctcttcggcaagggctccctagtgacctgcgctaaattccagtgtctggaacctatcgagggtaaggtcgtgcagtacgagaacttaaaatataccgtgatcatcacggtccacaccggggaccagcaccaagtgggcaacgagacccagggggtgaccgccgagattacaccgcaggcaagcaccaccgaagcgatcctgcccgagtacggcaccctcggccttgagtgctctccgcgcaccggcctggacttcaacgagatgattctgctcacaatgaagaataaggcctggatggtgcaccgacaatggttcttcgacctacccctgccctgggcctcaggcgccaccaccgaaaccccgacgtggaaccgcaaggagctcctggtgactttcaagaacgcccacgcgaagaagcaggaggtcgtggtcctagggtcccaggagggcgcgatgcacacggccctcacgggtgccacggaaattcaaaattccggcgggacctccatattcgcaggacacctgaagtgccgactgaagatggacaagctcgagctgaagggcatgtcctacgcgatgtgcaccaatacctttgtgttaaagaaggaggtgtccgagacgcagcacgggacgattctcatcaaagtggagtacaagggcgaggacgccccgtgtaagatccccttctcgaccgaggacggccagggcaaggcacacaatggccgcttaataacagcgaacccggtcgtgacgaaaaaggaggagcccgtcaacatcgaggcggagccacccttcggggaaagcaatatcgtcatcggtatcggggacaacgcacttaaaatcaactggtataaaaagggctccagcatcgggaaaatgttcgaagccaccgcccgcggcgcccgcagaatggcgatcctgggcgataccgcctgggacttcgggtccgtaggaggggtgcttaacagcttaggcaaaatggtccaccagatttttgggtccgcctacaccgctctgttcagcggcgtctcatgggtgatgaagatcggcataggggtcctcctgacgtggatcggtctgaacagcaagaacacctcaatgagcttctcgtgcatcgccatcgggatcatcacactctacttgggcgcggtggttcaggccgacatggggtgcgtcatcaactggaagggcaaggaactgaaatgcggcagcggaatctttgtgaccaacgaagtgcacacatggaccgagcagtacaagttccaagccgactcccccaagcgcctcgcgaccgccatcgctggcgcctgggagaacggggtgtgcggcatccgaagcacgacgagaatggagaacctgctgtggaagcagatagccaacgagctcaactacatcctctgggagaacaacatcaagttaaccgtggtcgtcggcgataccattggcgtactcgagcagggcaaacgcacgctgacgcctcagcctatggagctgaagtactcctggaagacctggggcaaggccaagatcgtaaccgcagagatccagaactcgtcgttcatcatcgacggccccaacactcccgagtgcccttcggcgtcccgcgcctggaacgtatgggaggtggaggactacggattcggcgtattcacgaccaacatctggctcaaactgcgcgaggtttacacccagctgtgcgaccaccggttgatgagcgccgctgtgaaggacgagcgcgctgttcatgccgacatgggttattggattgagtcacagaagaacgggtcatggaagctggagaaggctagcctgatcgaggttaagacctgtacctggcccaagtcccacacactttggagcaacggcgtgctggagtccgacatgatcatccccaagagcctcgccgggcccatctcccagcacaactaccggcctggataccacacccagaccgcagggccctggcacctcggcaagctggagctggatttcaactactgcgagggcaccacggtggtgatcaccgagagctgcgggacccggggcccgtccctccggacaacgaccgtttccgggaagctgatccacgagtggtgctgccgctcctgcaccctaccaccgcttagatacatgggcgaggacgggtgctggtacggcatggagatccgccctatctcggagaaggaagagaacatggtgaagagtctcgttagcgcgggctccgggaaggtggataacttcaccatgggcgtgctctgcctcgccatcctgtacgaggaggtgatgcgagggaagttcgggaagaaacacatgatcgccggggtcttctttacattcgtattactcctgagcggccagataacatggcgcgacatggcacacaccctgatcatgattggctccaacgccagcgaccgaatggggatgggcgttacctacctcgcgctaatcgccacgttcaagatccagcccttcctggccctagggttcttcctgcgcaagctgacgagccgggaaaacctcctgctgggagtaggcctcgccatggcgactaccctgcaactgcccgaggacatcgagcaaatggccaatggcatcgctctcggactgatggccctgaagctcatcacccagttcgaaacctaccagctgtggaccgcccttgtgtctttaacctgcagcaacacgatcttcaccttgaccgtcgcgtggcgcacagccaccttaatactcgcgggggtgtccctactgccggtctgccagagctcctcaatgagaaagacggactggcttccgatggctgtggcggccatgggtgtgccgcctctaccactcttcatctttagcctcaaggacactctcaagcgtcgcagctggcccctgaacgagggtgtgatggccgttggcctcgtgtccatcctggcgagctccttgctccgcaacgacgtccccatggccgggcccctggtggccggtggcctgctcatcgcgtgttacgttatcaccgggaccagcgccgacctgaccgtcgaaaaggccgccgatgtgacctgggaggaggaggccgaacagaccggtgtgtcccacaacctgatgataacggtcgacgacgacgggaccatgcgtatcaaagacgacgaaacggagaacatactcaccgtgctgctgaaaacggcactcctgatcgttagcggaatcttcccgtactccatccctgccacgctactggtctggcacacctggcaaaagcagacgcagcggagcggggtgctgtgggacgtcccctccccacccgagacccagaaggccgagctggaggagggggtctatcgaatcaagcaacagggcatcttcggaaagactcaggtgggcgtgggggtacaaaaggaaggtgtcttccacaccatgtggcatgtgaccagaggggcagtcctcacccacaacgggaagcgcctggagcccaactgggcttccgtcaagaaggacttaatctcctacggcgggggctggcgcctcagcgcccagtggcaaaagggtgaagaggtgcaagtcatcgcggtagagcccggcaagaaccccaaaaacttccagacgatgccaggcaccttccagaccactacgggggagatcggcgcaatcgccctggactttaaaccggggacgagcggctcccccatcattaatcgcgaggggaaggtggtggggctgtacggcaatggggtggtgactaaaaacgggggttacgtctcgggtattgcgcagaccaatgccgagcccgacggccctactcccgaactggaggaggaaatgtttaagaagcggaatctaaccatcatggatttgcaccccgggtcaggtaagacccgaaagtacctgccggccatcgtgcgcgaggccatcaagcgcagacttcggacgctgatcttagcccccacgagggtggtcgcggccgaaatggaggaggccctcaaaggcctgcccatccggtatcagaccaccgccaccaagagcgagcacacgggtcgggaaattgtggacctgatgtgccacgccaccttcaccatgcgtctcctgtccccagtgcgggtccccaactacaacctcatcgtgatggacgaagcgcacttcaccgaccccgcctccatcgcagccagggggtacatctccacgcgggtgggcatgggtgaggcggcggccatcttcatgacggcaacgccgcccgggaccgctgacgccttcccgcagagcaacgccccgatccaggatgaagaacgcgatatacccgagcggtcctggaacagcggtaatgagtggatcactgacttcgccgggaaaaccgtctggttcgttccctccatcaaggccggcaacgacattgccaactgcctacgcaaaaacgggaagaaggtgattcagttgagtcgcaaaacattcgacaccgagtaccagaaaacgaaactgaatgactgggatttcgtcgtgactaccgacatctccgagatgggggccaacttcaaggccgaccgggtgatcgacccgcgccggtgtctcaagccagttatcctgaccgacggccccgagcgagtcatactggccgggcccatgccggtgacggcagccagcgccgcccagcggaggggccgggtcgggcgtaacccccagaaggagaacgatcagtacatcttcacgggtcagccgctcaataatgacgaggaccacgcgcactggaccgaggcgaagatgcttctagacaatatcaacacccccgaggggatcattccggccttgttcgagcccgaacgagagaagtcagccgccattgacggagagtaccgcctgaagggcgaaagccggaaaaccttcgtggagctgatgcgccgcggggacctccccgtctggttagcccacaaagttgctagcgagggtatcaaatacacggaccggaaatggtgcttcgacggccagcggaacaaccagatcctggaggagaacatggacgtggagatctggacaaaggagggcgagaagaagaagctacgacctcgatggttagatgcgcgcacatacagcgacccgctggccctcaaagagttcaaggacttcgccgcaggccgcaagtccatcgccctggacctggtgaccgagatcgggcgggtgcctagtcatctcgcgcaccgcacgcggaatgccctggacaatctggtgatgctccacacctccgagcacggcggccgagcctaccggcacgccgtcgaggagctccccgagacgatggagaccctgctgctgttaggcctcatgatactcctgaccggaggggccatgctgttcctgatcagtgggaaagggataggcaagacgagcatagggctgatatgcgtgatcgcgtcgagcggcatgctatggatggccgaggtgccgctgcagtggatagcctccgccatcgtcctggagtttttcatgatggtgctcttgatccctgagcccgagaagcagcgcacgcctcaagacaaccagctggcctacgtagtgatcgggatcctcaccctggcggccattatcgcagccaatgagatgggcctgctggagaccaccaagcgggacctgggcatgagcaaggagcctggggtggtgtcccccaccagctacctggatgtcgacctccaccccgcgagcgcctggactctgtacgccgtggcgacgaccgtgatcacccccatgctgcggcataccatagagaacagcaccgccaacgtctccctcgcggctatcgccaaccaggccgtggtgctaatgggtctggacaaggggtggccgataagcaagatggacttaggcgtccccctgctggccttagggtgctactcccaagtgaacccgctgaccctaaccgcggccgtcctcctgctgatcacccattacgctattatcggccctggcctccaggctaaggcgacgcgtgaggcccagaagaggaccgccgccggtatcatgaagaatcccacggtcgacggcatcatgaccatcgatttagaccctgtgatatacgacagcaagttcgagaagcagctcggccaagtgatgctcctggtcctgtgcgcagtgcagctcttattgatgcggacttcctgggccctctgcgaagccctgacgctggccaccggcccaatcaccacgctttgggagggcagcccggggaagttctggaacaccactatcgccgtgtccatggccaacatctttcggggcagctatctggccggtgccggcctggccttctcgatcatgaagtcggtcgggactggtaagcggggtacggggagccagggcgagacactcggggagaaatggaaaaagaagctgaaccagctgtcccgcaaggagtttgacctctataagaaatctggcataaccgaggtggaccggaccgaagcaaaggaggggctgaagaggggcgagaccacccaccacgccgtctcccgtggcagcgcgaagctgcagtggttcgtcgaaaggaatatggtggtgccggaaggtcgggtcatcgacctcggctgtggccgcggcggatggtcctactactgcgccggtctgaagaaggtgaccgaggtccggggctataccaagggagggcccgggcacgaggagccagtccccatgagcacctatggctggaacatcgtgaagctgatgtccgggaaggacgtattctacctaccacccgaaaaatgcgacaccctgctgtgcgacattggcgagagctccccgagccccacagtcgaggagtcccgcaccatccgggtgctgaagatggtggagccctggctcaaaaacaaccagttctgcatcaaggtcctgaacccttacatgcccacggtgatcgagcaccttgagaggcttcagcgcaagcacggcggtatgttagttcggaatcctctgagccgcaactccacgcacgagatgtactggatcagcaacgggacggggaacatcgtctcaagcgtgaacatggtgtcgcgactcctattaaaccgctttaccatgacccatcggcgcccaacaatcgagaaggacgttgacctcggcgccggcacgcggcacgtgaacgcggagcccgagaccccgaacatggacgtcattggggaacgcattaagcggatcaaggaggagcacaacagcacctggcactacgacgacgagaacccgtacaagacgtgggcctaccacggcagttacgaggtgaaggccaccgggagcgcgagctctatgatcaacggcgtggtcaaacttctgaccaagccctgggacgtggtacccatggtcacgcagatggcaatgacggatacgacccccttcgggcagcagcgcgtgttcaaagagaaggtggacacccggacgccgagacccatgcccggcaccaggaaggtcatggaaatcacagccgagtggctctggagaacgctgggccgaaacaagcgcccccggttatgcacgagggaggagttcaccaaaaaggtccgcaccaacgccgctatgggcgctgtgtttacggaagagaaccagtgggatagcgcaaaggcagccgttgaggacgaggagttctggaaactcgtagaccgggaacgcgagctgcacaagctggggaagtgtgggtcctgcgtgtacaacatgatgggcaagcgggagaagaagctcggcgagttcggcaaggcgaagggcagccgcgccatctggtacatgtggctgggagcccggtacttggagttcgaggccttgggcttcctgaacgaggaccactggttctcaagagagaacagctactccggggtggaaggtgagggactgcacaaactcggctacatcctgcgtgatatatctaaaatcccgggcggggccatgtacgccgacgacaccgccggctgggacactcgcatcaccgaggatgatctgcacaacgaggagaagatcatccagcaaatggaccccgagcaccggcagctcgccaacgccattttcaagctcacctatcaaaacaaggtggtgaaggtccagcgccccacgccgaccgggaccgtaatggatatcatctcccggaaggaccagcgcggcagcggccaggtagggacctacggactgaacaccttcacgaacatggaggcgcagctcgtccggcagatggagggtgagggagtgctgaccaaggccgacctggagaacccgcacttgccggagaagaagattacgcagtggctcgagaccaagggggtggagagactgaagcggatggcgatcagcggcgacgattgcgtggtgaagcccatagacgatcgttttgccaatgcgctcctggccctgaacgacatgggtaaggtacggaaagacatcccccagtggcaaccgagccgcggatggcacgattggcaacaggtccctttctgtagtcatcacttccatgagctcataatgaaggatggccggaaactggttgtgccctgccgcccgcaggatgagctgatcgggcgggcccgcatctcacagggtgccggttggtccctccgcgagacggcctgcctgggcaaggcatacgcccaaatgtggagcctgatgtacttccaccgtagggacctgcggctggcctccaacgccatctgcagcgcagtcccggtgcactgggtgcccacgagtcgcaccacctggagcatccatgcgcaccaccagtggatgaccactgaggatatgctaaccgtctggaaccgtgtatggatcgaggaaaacccgtggatggaggacaaaacccccgtcacgacctgggagaacgtcccgtacctcggcaaacgcgaggatcagtggtgcgggagtctcatcggcctgacttcccgggcaacatgggcccagaacatcctcactgcgatccagcaggtccgcagcctgatcgggaacgaggagttcctggattacatgccctccatgaagcgattccgcaaggaggaggaaagcgagggcgccatctggtag

SEQ ID NO: 26176 - RNA, 9873 nt, synthetic construct
  misc_feature 1..9873: note = derived and/or modified CDS sequence (opt11) from DENV-3__JQ411814__SS-prME
  source 1..9873: mol_type = other RNA
accagcctatgtctaatgatgatcctgcccgccgcgcttgccttccatctcacgtctcgggacggcgaaccgcgcatgatcgtcgggaagaacgagcgaggtaagagcctgctttttaagactgcaagcgggatcaatatgtgcaccctcatcgccatggaccttggggagatgtgcgacgacaccgtgacctataagtgcccccacatcaccgaggtggagcctgaagacatcgactgctggtgtaacctaacgagcacctgggttacgtatgggacctgcaaccaggccggcgaacatcggcgcgataagaggtcagtggccttggcgccccacgttggcatggggctggacacccgcacgcagacctggatgtctgcggagggcgcgtggagacaggtggagaaggtggagacgtgggccctccgccatcccgggttcactatcctcgctttgttcctggcccactacatcggaacatccctaacccaaaaggttgtgatctttattctcctgatgctcgtcacgccgtcgatgaccatgcggtgcgtcgggatcggaaaccgcgacttcgtagagggcctctccggggccacctgggtcgatgtggtgctcgaacatggcggatgcgtcaccaccatggctaagaacaagccgactctcgacatcgagctgcagaagaccgaggccacccaactcgccacgctccggaaactgtgcatcgagggaaaaattacgaacattactacggactcccggtgccccacgcagggggaggccgtactgcccgaggaacaagatcagaactacgtgtgcaagcacacctacgtcgatcgggggtggggcaacgggtgcggcctcttcgggaagggctccctggtgacctgcgctaagttccagtgcctggagcccatcgaaggcaaggtagtacagtacgagaacttgaagtataccgtgatcataacggtgcacaccggggaccagcatcaggtcggcaatgaaacgcagggagtgaccgccgagatcacgccccaggcctccaccactgaggcgatcctacctgagtacggcaccctggggctcgagtgctccccgcgcaccggcctggacttcaatgagatgattctgctcacgatgaagaacaaggcctggatggtccaccgacagtggttcttcgatctgcccctgccctggaccagcggcgccaccaccgagacgccgacctggaaccgcaaggagctactggtgacattcaagaatgcccacgccaaaaagcaagaggtagtcgtgctggggtcccaggagggagcaatgcacacggccttgacgggtgccacggagatccagaacagcggagggacatccattttcgccggtcatctgaagtgccggttgaagatggacaagctcgagctgaagggaatgagctacgcaatgtgcactaacacgttcgtactaaagaaggaggtcagcgagacccagcacgggactatcctcatcaaggttgagtataagggggaggacgcgccctgcaagattccgttcagcactgaggacggtcagggcaaggcccacaacggccgcctgatcaccgccaacccagtagttaccaaaaaggaggagcccgtgaacatcgaggctgagccacccttcggggaaagcaatatcgtgatcggcatcggggacaacgcgcttaagatcaactggtacaagaaaggctccagcatcgggaaaatgttcgaggccacggcccggggtgcacgccggatggccatcctgggcgacaccgcgtgggatttcggctccgtcggtggggtcctcaactcactgggcaagatggtgcaccagatcttcgggtcagcgtacacggccctgttcagcggagtctcctgggtgatgaaaatcggaatcggggtgctcttaacgtggatcggactgaacagtaagaataccagtatgagcttctcctgtatagccatagggataatcaccctctacctgggcgccgtcgtgcaggcggatatggggtgcgtgataaattggaagggcaaggagctgaaatgtggcagcgggatcttcgtgacgaatgaggtgcacacatggaccgaacagtacaaattccaggccgacagccccaagaggctcgccaccgccatagctggagcgtgggagaacggggtgtgcggcattaggtccactacccggatggagaacctactgtggaagcagatagccaacgagttaaactatatcctgtgggagaataacatcaaacttacggtcgttgtgggggacaccatcggcgtcttggaacagggcaagcggacgttgacgccccagccgatggaactgaagtactcctggaagacctggggcaaggccaagatcgtgaccgcggagacgcaaaatagcagtttcattatcgacggtcccaacacccccgagtgcccgagcgcgagccgggcctggaacgtgtgggaggtcgaggactatgggttcggcgtgttcacgaccaacatatggctcaagttacgagacgtctacacgcaactgtgtgaccaccgtcttatgagcgccgccgtcaaggacgagcgagccgtgcacgccgacatgggctactggatcgagagccagaagaacgggtcctggaaacttgaaaaggccagcctgatcgaggtcaagacttgcacctggcccaagtcccacaccctctggtccaatggcgtgctggagtccgacatgatcattcccaagtcgctagctggacccatctcccagcataattatagaccaggctaccatacacagacggcaggcccatggcaccttgggaagctggagctggacttcaactactgcgaaggaaccacagtggtaataactgagaactgtggaacgcgcggccctagcctccggaccaccaccgtctccgggaagctgatccacgagtggtgctgccgcagctgcacgctgccgccgctccgctatatgggtgaggacgggtgctggtatggaatggagatacgccccatctccgagaaggaggagaacatggtcaagagcctggtatctgccggcagtggcaaggtcgataacttcaccatgggcgtgctgtgtctcgcaatcctgttcgaggaggtgatgcggggcaagttcggtaagaagcatatgatcgccggcgttttgttcacgttcgtgctcctgttgtccggacagatcacgtggcgcgacatggcacacaccttgatcatgataggctcaaatgcgtccgaccggatgggcatgggggttacctatctggctctgatcgcaacattcaaaatccagcctttcctcgccctggggttcttcctgagaaagctcacctcccgtgagaacctgcttcttggcgtcggcctggcgatggctacgaccctgcagctccccgaggacatcgagcagatggcgaatgggattgcactgggcctgatggctctcaaactgattacgcaatttgagacataccagctgtggacggcactcgtgagtttgacctgctcgaacaccatcctgaccctcacggtggcctggcgcacggcgactctgatcctagccggggtctcactccttccggtgtgccagtccagctccatgcggaagaccgattggttgcccatgacggtcgcagctatgggcgttccgccacttcccctgtttatcttcagcctgaaggacaccctcaagcgccgctcctggcccctgaacgagggagtgatggccgtcggcttggtctcgatcctcgcgtccagcttgctgcggaatgacgtgcccatggcgggcccactcgtcgccgggggccttctcattgcttgctacgtaataaccgggacctccgcggacttgacggtcgagaaggcggccgatgtcacctgggaggaggaggccgagcagaccggcgtgtctcacaacttaatgatcaccgtcgacgacgacgggaccatgcgcatcaaggacgacgaaactgagaacatccttaccgtactcctgaagaccgccttgctcattgtttccggcatctttccgtactcaatcccggccacgctcctagtgtggcacacgtggcagaagcagacccagcggagcggagtcttatgggatgtgccctcaccacccgaaacccagaaggcggagctggaggagggagtgtaccgcatcaagcagcaaggcattcttggcaagacacaggtcggcgtgggagtgcagaaggagggtgtcttccacacgatgtggcacgtcactcggggcgccgtgttgacccacaatgggaaacgcctggagccaaactgggcgtccgtcaaaaaggacctgatcagctacggagggggctggcgactctccgcacaatggcagaaaggggaggaagtgcaagtgatcgccgtcgagcccggcaagaaccccaagaactttcaaaccatgcccggcacattccagactaccacgggggagatcggcgcaatcgctctcgacttcaagcccggcacaagcggctcccctatcattaacagggagggcaaggtggtgggtctgtacgggaacggtgtcgttacaaagaacgggggatacgtgtccggcattgcgcagaccaacgccgagccggacggacctactcctgagttggaggaggagatgttcaagaagagaaacctgactatcatggacctgcaccccggaagcggcaagaccaggaagtacctccctgcgatcgtccgggaggccatcaagcgccggctccggaccctgatcctcgctcccacccgggtggttgccgccgaaatggaggaagcgctgaagggactgccaatccgctaccagacgactgccaccaaatccgagcacacgggtcgggagatcgtagacctcatgtgccacgccacgtttaccatgcgcctcctgagcccggtgcgcgtgcccaattataacctgatcataatggacgaggcccatttcaccgaccccgcctccatcgctgcccgcgggtatatcagcacccgagtcggcatgggcgaagccgctgcgatcttcatgacagcaacaccgcccgggactgccgacgccttcccgcagtccaacgcccccatccaggatgaggagcgcgatatcccggagcgcagttggaactccggcaacgagtggatcaccgacttcgcagggaagactgtgtggttcgtgcccagcataaaggccggcaacgatatcgccaactgcctcagaaagaatgggaagaaggtcatccaactgtcccggaagaccttcgacaccgagtaccagaagaccaaacttaacgattgggacttcgttgtgactaccgacatctctgagatgggagcgaacttcaaggccgaccgggtaatcgacccgcgccggtgcctcaagcccgtaattcttaccgacggacctgagagggtgatccttgcgggccccatgccggttaccgcggcctccgccgcacagcgccgcggccgtgtcgggcgtaatccccagaaggagaacgaccagtacatctttaccggccagcctctcaacaacgatgaagatcatgcgcactggacagaggccaagatgctattggacaatattaacacccccgaggggatcatcccggccctcttcgagcccgagcgggaaaagtccgccgcgatcgacggcgagtaccgcctaaagggcgagagccggaagacctttgtagagctgatgcgccgcggggacctgccggtctggctcgcccacaaggttgccagcgagggcatcaaatacaccgaccgcaaatggtgcttcgacgggcaacggaacaaccagatcctggaagaaaacatggatgtggagatatggactaaggagggcgagaagaagaagctccgcccacggtggctggacgcccgcacctactccgacccgttggccttaaaggagttcaaggatttcgctgccggcagaaagagcatagccctggacctggtgaccgagattgggcgggtgccttcccacctcgcccaccgcacccggaacgcactggataacctggtcatgctccacaccagcgagcacgggggcagggcttaccgtcacgccgtcgaggagcttccagagaccatggagactctactcctgcttggcttaatgatcctgctgacagggggcgcgatgctgttcctgatcagcggcaaggggattggcaagacctccattgggctgatctgcgtgatcgccagctccggtatgctgtggatggctgagatcccgcttcagtggatagcgagtgcgatcgtcctggagttcttcatgatggtgctcttgatcccggaacccgagaagcagcgcactccacaggacaaccagctggcatacgtggtcatcgggatcctcaccctagccgcaattatcgccgccaacgagatgggcttgctcgagaccaccaagcgagacctcggcatgtcaaaggagccgggggtggtgagccccacttcctacctggacgtcgacttgcatccagccagtgcttggaccctgtacgcagtggcgacaacggtgataactccgatgttgcgtcacaccatcgaaaattccacggccaacgtctcactcgccgctatcgcgaatcaggccgtggtgttaatgggcctggacaagggttggccgatctccaaaatggatttaggcgtaccactgcttgccctcggctgctattctcaagtgaacccgctgacgctaaccgcagcagtactcctgttgatcacccattacgcgatcataggacccggcctccaggccaaggccacgcgtgaagcgcagaagcgcactgccgcagggatcatgaagaacccgaccgtagacggcatcatgaccatcgaccttgaccccgtgatctacgacagtaaattcgaaaagcagctgggccaggtgatgttactcgttctttgcgctgtgcagttattgctgatgcggaccagctgggctctctgtgaggccctgactctggcgactggcccaatcaccacactctgggaaggctcccccggcaagttctggaacaccaccatcgcagtgtccatggccaacatcttccgcgggtcatacctcgccggggccggcctagcgtttagcattatgaagtccgtcggtaccggcaagcggggcactgggtcacagggagagactcttggtgagaagtggaaaaagaagctgaaccagttatcccgcaaggagttcgacctgtacaagaaatccggcatcacggaggttgaccggacagaagccaaggaggggctgaaaaggggcgagatcactcaccacgcggtgagccgggggtccgccaaacttcagtggttcgtcgagcgcaacatggtgatccctgaagggcgggtgatcgatctcggctgtggtcggggcgggtggagctactattgcgccggactgaagaaggtcacagaggtgagaggttacaccaaagggggtccgggccacgaagaacccgtgcccatgtccacctacggatggaatatcgtaaagctgatgagcgggaaggacgtattctacctgccgccggagaaatgcgacaccctcctgtgtgacatcggcgaatccagcccctcccccaccgtggaggagagccgcacgatccgcgtcctgaagatggtggagccttggctcaagaataatcagttctgcatcaaagtattaaatccctacatgccgaccgtgattgagcacctggagcggcttcaacgcaagcatggcggaatgttagtacggaaccccctgtcccgaaacagcacacacgagatgtactggatctctaacggcaccggcaatatcgtgagctccgtcaacatggtgagccgactcttgttaaaccgctttacgatgacccaccggcgaccgacaatcgaaaaggacgtggacctcggcgcggggaccagacacgtcaacgccgagcccgagacgcccaacatggacgtaattggggagcgaattaagcggatcaaagaggaacacaactccacctggcactacgatgacgagaacccttacaagacctgggcctaccacgggagctatgaggtaaaggccacggggtctgccagcagcatgattaacggcgttgtaaaactgctgacgaagccctgggatgtcgttcctatggtgacccaaatggcgatgaccgacaccacgcccttcgggcaacaacgtgttttcaaagaaaaagtggatacccggactccccgccccatgcccggaactcggaaagttatgggcatcacggccgagtggctctggaggaccttagggcgtaacaagcgcccccggctgtgcacccgcgaggagttcaccaaaaaggtccgcacgaacgccgccatgggcgcggtgttcaccgaggagaaccaatgggactccgccaaagcagccgtggaggatgaggaattttggaagctcgtcgaccgggagcgcgaactgcacaagctgggtaagtgcggcagctgtgtctacaacatgatggggaagcgggaaaagaaattgggtgagttcggcaaggccaagggctcccgggcgatctggtacatgtggctgggcgcccgctacctggagtttgaagcgctcggtttcctcaacgaggaccattggttttcacgcgacaactcctactctggcgtggagggagaggggctgcacaagctcggctacatcctgcgggacatctccaaaatccccggcggtgccatgtacgcggacgacacggccggatgggacaccaggatcactgaggacgacctgcacaatgaggaaaagatcacccagcagatggaccccgaacaccgtcagctcgccaacgcaattttcaaactgacctaccagaacaaggtggtgaaggttcaacgccccacccccacggggacggttatggacatcatctcacgtaaggaccagcggggaagcggccaagtgggcacgtacgggctgaacacatttacaaacatggaggtccagctcgtccggcagatggagggcgagggcgtgctgtcgaaggccgacctggaaaacccacacctccccgaaaagaagataacgcagtggctagaaaccaagggggtggagcggctgaaacggatggccatctctggagacgattgcgtcgtgaagccgatcgatgaccgcttcgcgaacgccctcctagccttgaacgacatgggtaaggtgcgaaaggacatcccacaatggcagcctagcaagggctggcacgactggcaacaggtaccattctgctcccaccacttccacgagcttatcatgaaagatgggcgcaagttagtggtaccctgtcggccccaggatgagctgatcggcagagcccggataagccagggtgcgggatggtcactccgcgagacggcttgtctgggcaaggcctatgcccagatgtggagcctgatgtatttccaccgacgggacctcagactggccagtaacgccatatgtagcgcagtcccggtgcattgggtgcccacctcccggaccacctggagcatacacgcccaccaccagtggatgacgactgaagatatgcttacggtctggaaccgcgtgtggatagaggacaacccctggatggaggacaagaccccagtgaccacttgggaaaatgtcccttacctcgggaagagggaagaccaatggtgcgggtcgctaatcggactcacgtctcgcgccacctgggcgcagaacatccccacagcgatccagcaggtccgtagccttatcggtaatgaggagttccttgactatatgccctccatgaaacggttcaggaaggaggaggagtcggagggagccatatggtga

SEQ ID NO: 26177 - RNA, 9873 nt, synthetic construct
  misc_feature 1..9873: note = derived and/or modified CDS sequence (opt11) from DENV-3__KM190937__SS-prME
  source 1..9873: mol_type = other RNA
acctcactgtgcctcatgatgatgcttcccgctaccctagccttccacctcaccagccgggacggcgagcccagaatgatcgtgggcaaaaacgagcgaggaaagagcttgctgttcaagactgcctccgggatcaacatgtgcactctcatcgccatggacttaggggaaatgtgcgatgacaccgttacgtacaagtgcccccacatcaccgaggtggagccggaggacatcgactgctggtgtaatctcaccagcacctgggtgacctacgggacctgcaatcaggccggcgagcaccgacgagacaagcggagtgtggccatcgcgcctcatgttgggatggggttagatacccgaacccagacttggatgagcgcggagggtgcctggcgccaagtagagaaggtggagacctgggctctgcgccacccagggtttaccatcctggccctcttcctggcacactacatcggcacctccctgactcagaaggtcgtgattttcatcctcctgatgctggtcactccctctatgaccatgcggtgcgtcggggtgggaaatcgcgacttcgtcgagggcctcagcggggcgacctgggtcgacgttgtcctggaacatggcggatgcgtgacgaccatggccaaaaacaagcccaccctggacatcgagctccagaagacagaagccactcaactggcaaccctgcgaaagctatgcatagaaggcaagataaccaacatcaccacagacagccgctgtcccacgcaaggcgaggcgattctgccagaggagcaagaccagaactacgtgtgcaagcacacctacgtcgatcgggggtggggcaacggttgcggcctgttcgggaagggctccctcgtgacctgcgcaaagttccagtgccttgagtccatcgaaggcaaggtggtccagcacgagaacctgaagtatacagttatcatcacagtgcataccggggaccagcatcaagttggcaacgagatgcaaggggttaccgccgagatcacaccgcaagcctccaccgcggaagtcatcctccccgagtacggcaccctaggcctggaatgcagcccccgcaccgggctcgacttcaacgagatgatctccttgaccatgaagaataaagcgtggatggtccaccgacagtggttcttcgacctgccgttgccctggacgagcggagccaccgcagaaacccccacctggaatcgcaaggagctcctggtgacattcaaaaacgcccacgccaagaagcaggaggtcgtagtgctcgggagccaggaaggcgccatgcacacagccctgaccggtgcgaccgagatccagacgagcggcggtacctccatatttgccggacacttgaagtgccggctcaagatggacaaactggagctgaagggcatgtcctatgccatgtgcctctcctccttcgtgctgaagaaggaggtgtccgaaacacagcacgggacgatcttgatcaaagtggagtacaagggcgaggatgcgccttgcaagattccgtttagtacggaggacgggcagggcaaagctcacaacggccgcttaatcaccgctaatcctgtcgtgacgaagaaagaggaaccggtgaacattgaggccgagcccccgttcggagagtcaaatatcgtcataggcatcggggacaaagcgctgaagataaactggtacaagaaaggctccagcatcggtaaaatgttcgaggccacagcgcggggtgccagaagaatggctatcctgggagacacagcctgggactttgggtcagtgggcggggtgctcaacagcctcggcaagatggtacaccagatctttgggtccgcctacacagcactgttcggcggcgttagctggatgatgaagatcgggatcggcgtgctgctaacttggatcggcctgaacagcaaaaatacgagcatgagtttcagctgcatcgccataggcatcatcacgctgtacctcggggcagtcgtgcaggcggacatgggctgtgtgatcaactggaaaggcaaggagctgaagtgcggctccggcatatttgtgaccaacgaggtccatacctggactgaacagtacaagttccaggcagacagccccaagcgccttgccaccgccatcgctggtgcgtgggagaacggcgtgtgcgggatccgctccacgacccgaatggagaacctcctgtggaagcagatcgccaatgaactgaactacatcctctgggaaaacaatataaaactgacagtcgtggtaggcgacatcacgggcgtcctcgaacaagggaagcgcactctcacgccacagccaatggagttaaagtactcctggaagacctgggggaaggccaagatcgttacagcggagacgcagaactcctcgttcatcatcgacgggccgagtactccagagtgcccctccgcgtcccgggcgtggaacgtctgggaggtcgaggactatgggttcggcgtgttcactacgaacatctggctgaaactgcgcgaggtgtacactcagctgtgcgatcaccgtcttatgtccgccgccgtcaaggacgagcgcgccgtgcacgcggatatggggtactggattgagagccagaagaacggatcctggaagctcgaaaaagcgagcttcattgaggtgaagacgtgcacctggcccaagagtcacactctatggagtaacggcgtcctggagtccgacatgatcatccccaaaagcctcgccggccccatttcacaacacaaccaccggcctggttaccacacgcaaaccgccggcccgtggcatttgggcaaactggaactcgacttcaactactgcgaaggtactactgtggtgataagcgaaaactgcggcacgagagggccctcccttcggactaccaccgtttctggcaagctgatccacgaatggtgctgccgatcctgtacactaccgcccctacggtacatgggggaagacggctgctggtacggcatggagatccgccccatcaacgagaaggaagagaacatggtcaaatctctggccagtgcagggtccggcaaggtggacaatttcaccatgggggtcctctgcctggcgattttattcgaggaagtgatgcggggcaagttcgggaagatccacatgatagccggggtactcttcactttcgtcttgctgctgagcggacagataacgtggcgcgacatggctcatacgctcatcatgatagggtctaatgccagcgaccggatgggcatgggcgtgacctatctggcgctcatagctaccttcaagatccagccattcctggccctgggcttcttcctcagaaagctgacctcccgagagaacctactcctgggggtggggctggccatggcggccaccctccgcctgcctgaggacatcgaacagatggccaacggaatcgccttggggttaatggccctgaagctcataactcagttcgagacctaccagctctggaccgcgctggtcagcctgacgtgttccaacacaatcttcaccttaaccgtggcctggcgtacggccacgctgattcttgccggcatcagcctgctgcctgtgtgccaatcttcttctatgcgcaaaactgattggctgccgatgaccgtggccgcgatgggggcccaacccctgcccctgttcatcttcagcctgaaggacacgctcaaacggagatcctggcccctgaacgagggcgtgatggccgtcggactggtttcaatcttggcctccagcctgttgcgtaatgatgtgccgatggccgggcccctcgtagcgggcgggctgctgatcgcgtgctacgtgatcactggtacctccgccgacctcaccgtggagaaggccgccgacgtaacgtgggaggaggaagctgaacagaccggggtaagccataacctgatggtgaccgtcgacgacgacggcaccatgaggatcaaagacgacgagacggaaaacatcctgaccgtgctccttaaaactgcgctgctcatagtctccggcatcttcccttatagcattcccgccaccctgctggtctggcacacctggcagaaacagactcagcgctcaggggtgctctgggacgtgccgtcccctcccgaaacccagaaagcagagctggaagagggcgtctaccggataaaacaacaggggatttttggcaagactcaagtgggtgtgggcgtgcagaaggagggcgtgttccacaccatgtggcacgtgacgcgcggggctgtcctgacccacaacgggaagcgcctcgagcccaactgggccagtgtgaagaaggatctgatatcctatgggggcgggtggcgactgagcgctcagtggcaaaagggagaggaggtgcaggtcatcgctgttgagcccggcaagaaccccaagaactttcagaccatgcccgggatctttcaaactaccaccggagagatcggggccatcgccttggactttaagcccggtacatccggctcgccgataatcaaccgggagggcaaggtcgtagggctgtacgggaacggcgtagtaaccaagaacgggggctacgtttccggcatcgcccagacgaacgccgaacccgacgggcccaccccggagctggaggaggagatgttcaagaaacgcaacctgactattatggacttgcaccccggctctggtaagacccggaagtacctccccgcgatagtgcgcgaagccatcaagcggcgccttcggaccctcatactggcgcccaccagagtggtcgccgccgagatggaggaggccttgaaggggctcccgatcaggtaccaaacaaccgccaccaagtccgaacacaccgggcgcgagatcgtggatctgatgtgccatgcgaccttcacgatgcgattgctcagtcctgtaagagtcccaaactataacttaatcattatggacgaggcccatttcacagaccccgccagcatagccgcacggggctatatcagcacccgcgtaggcatgggagaggcagccgccattttcatgaccgccacgccgcccggcacagcggacgcattcccccagtctaacgcccccatccaggacgaggagcgtgacataccagaacgaagctggaactccggtaacgagtggattaccgacttcgttggcaaaaccgtatggttcgtgcccagcattaaggccgggaatgacatcgctaactgccttcgaaagaacggtaagaaagtcatccagctctcccggaagaccttcgacactgagtaccagaaaactaaactgaatgactgggacttcgtcgtgacaaccgacatctcagaaatgggcgcgaattttaaagccgaccgcgtgatcgaccctaggcgatgcctgaagcccgtcattcttacggacgggccggagagggtgatcctggccggccccatgcctgtgaccgtcgcctccgccgctcagcgccggggtcgcgtgggacgcaacccacagaaggagaacgatcaatacatcttcatgggccagccgctgaacaatgacgaggaccacgcccactggacggaggccaagatgctcctggacaatatcaatactcccgagggaataatccccgctcttttcgaacccgagcgcgaaaagtccgcggccatcgacggcgagtaccgcctcaaaggagagtcccgcaaaacgttcgtggagctgatgcggaggggtgacctgccggtttggctcgcgcataaggtggccagcgaggggatcaagtacaccgaccggaaatggtgctttgatggcgagagaaacaaccagatactggaggagaacatggacgttgagatctggaccaaggagggcgagaagaaaaagctgagaccacgctggttagacgcccgcacctatagcgaccccctggcgcttaaggagtttaaggacttcgctgccgggcgtaagtctatcgccctggatctggtgaccgagattggccgcgttcctagccaccttgcccaccggacgcgaaacgcactcgacaatctcgtcatgctgcatacctctgagcacgggggccgcgcgtaccgccacgccgttgaggaactcccggagaccatggaaaccctgcttttgctggggctgatgatcctactgacgggcggtgccatgctgttcttaatatcggggaaaggcatcggtaagacctccatcggcctgatctgcgtgatcgcttcttccggcatgttgtggatggcggatgtccccttacaatggatcgcaagtgccatcgtgctggagttcttcatgatggtgctactcattcccgagccagaaaagcagcgaacaccccaggacaaccagctggcctacgtcgtcatcgggattctgaccctcgccgcgatcgtggccgccaacgagatgggcctgctggaaacgaccaaaagggacctcggcatgtcaaaggagcccggggtcgtgagccccacctcctacctggatgttgaccttcacccggcgagcgcatggaccctttacgccgtcgccacgaccgtgatcacccccatgctgcggcacaccatcgaaaattccacggcgaacgtgagcctagccgcaatcgccaaccaggccgtcgtgctcatgggcctggacaagggctggcctatctccaagatggacctaggggtgcccctgctggccctggggtgttacagccaggtcaacccgctcaccctggccgcggccgtcctgttacttgtgactcactatgccatcatcggccccggcctgcaggccaaggccacccgcgaagcgcagaagcggacggccgccggcatcatgaagaacccaaccgtagatgggatcatgaccatagatctcgacccagtaatctacgattccaagttcgagaagcagctgggccaggtgatgctgttagtcttgtgcgctgtccaattgctcctcatgcggacttcatgggctctgtgcgaggtgcttaccttggccaccgggccaattaccaccctgtgggaggggtcccccggcaaattctggaacacaaccatcgccgtcagcatggcaaatatcttccgggggtcttacctcgccggtgccgggctggcattctccataatgaaaagcgtgggtacgggcaagcgggggaccggttctcagggcgagacgcttggagagaaatggaagaagaaactcaaccagctgagccggaaagagttcgacctgtacaagaagtccgggatcaccgaggtggaccgaaccgaagccaaggaaggtctaaagaggggcgaaatcacccaccacgccgtcagcagagggagtgccaagctacagtggttcgtggaacggaacatggtaatccccgagggccgcgtcatcgacctggggtgtggccggggcgggtggagctactactgtgcggggctcaagaaggtgacggaggtgcgcggatacactaaaggcggccccgggcacgaggagccggtccccatgtcgacctacgggtggaacatcgtgaagctgatgagcggcaaagacgtcttctacctcccgcccgaaaagtgcgatacgctcttatgcgacatcggcgagtccagcccctcgcccactgtggaagagagccggactatacgggtgctcaagatggtggagccctggctgaagaataatcagttctgcattaaggttctcaacccctatatgccgacggtgatagaacacctggagcgcctgcagcgaaaacatgggggaatgctcgtcagaaatcccctttcccggaatagcacgcatgaaatgtactggatctccaacgggaccggcaatattgtcagctccgtcaacatggtgagccgcctcctcctgaacagattcaccatgacccaccgacggcccacgatcgagaaggacgtagaccttggcgcagggacccgccacgtaaatgccgagcccgagacgccgaatatggacgttattggcgagcggataaagcgcatcaaggaggaacacagctccacctggcactacgacgacgagaacccctacaagacatgggcgtaccacggtagctatgaggttaaggcaacaggatccgcgtcgtctatgatcaacggcgtcgtcaagctccttactaagccttgggacgtcgtgccgatggtcacacagatggccatgaccgacaccacgccctttggccagcaacgggttttcaaagagaaggtcgacacgagaacgccccggccaatgccaggcacccgcaaggtcatggagatcaccgcagagtggctgtggagaaccctcgggcgaaacaagcggccccgcttgtgcacaagagaggagttcacaaagaaggtgcggacaaacgcagctatgggtgccgtgttcaccgaggagaaccaatgggacagcgcccgagcggccgtggaggacgaggagttctggaaactcgtggatcgggagcgcgaactgcacaagctggggaagtgcggttcttgcgtgtacaatatgatggggaaaagggagaagaaactgggcgaatttggcaaggcgaaggggagccgagccatctggtacatgtggctcggcgccagatatctcgagttcgaggccctggggttcctcaatgaggaccactggttttccagggagaactcttattccggcgttgaaggggagggtttgcacaagctgggctacatcctgagagacatcagcaagatccctggcggtgctatgtacgcggatgacaccgctgggtgggatacccgcatcacggaggacgacctgcacaacgaggagaagatcactcagcagatggacccagagcaccggcagctggccaatgccatcttcaagctcacctaccagaacaaggtggtgaaggtccagcgcccgaccccaaaaggcacggtgatggatataatctcgcggaaagaccagagaggctccggccaggtgggcacctatggacttaacacttttactaacatggaagcccagctgatacggcagatggagggcgagggggtcctctctaaagctgacctggagaacccccaccccctggagaagaagatcacgcagtggctcgagaccaagggggttgagcgcctgaagcgtatggctatcagcggggacgactgtgtggtcaagccgattgacgaccgcttcgccaacgccctactcgccctgaatgacatgggtaaggtgcggaaggacatcccgcagtggcagccctccaagggatggcacgattggcagcaggtccctttctgctctcaccacttccacgagctgataatgaaagacgggcgcaaactcgtcgtgccttgccggccccaggatgagttgatcggccgcgctcgcatcagtcagggggccggctggtctctgcgggagacggcgtgcctcggcaaagcctacgctcagatgtgggctctgatgtacttccatcgccgggatttacgtctcgcaagcaatgctatctgttccgccgtgcccgtacactgggtccccacttcccgtaccacgtggtccatccacgcgcaccaccagtggatgaccaccgaggacatgctgaccgtgtggaaccgcgtttggatagaggacaacccgtggatggaggacaagacgcccgtgacgacctgggaggacgtgccctacttagggaagagggaggaccagtggtgcggcagtctcataggactcacttcccgtgccacgtgggcccagaacatcctgacggccatccagcaagttaggagcttgatcggcaatgaggagttcctggactatatgccatccatgaagcgcttcaggaaggaagaggagagcgagggcgccatatggtga

SEQ ID NO: 26178 - RNA, 9873 nt, synthetic construct
  misc_feature 1..9873: note = derived and/or modified CDS sequence (opt11) from DENV-3__JQ920487__SS-prME
  source 1..9873: mol_type = other RNA
accagtctgtgcctcatgatgatgctgcccgccactctggccttccatctcaccagcagagatggcgaaccacggatgatcgttgggaaaaacgaacgcggcaaatccctactgttcaaaaccgccagcgggatcaacatgtgcaccctgatcgctatggatctaggcgagatgtgcgacgacaccgtcacttacaaatgcccgttaattaccgaagttgagcccgaggacatcgactgctggtgtaacctcacttccacctgggtcacctatgggacctgcaaccaagccggcgagcaccgaagagataaacgctcggtggccctggcgccccatgtgggcatggggctggacacccgcactcagacttggatgagcgcggagggagcctggcgtcaggttgagaaagtcgagacatgggcattccgccaccccgggttcaccatccttgccctgttccttgcgcattacatcggtacttctctgacgcagaaagttgtcatcttcatcctgctgatgctcgtcacccccagcatgaccatgcggtgcgtgggagtgggcaacagagatttcgtcgagggcctgtccggggcaacctgggtggacgtggtcctggaacacggcgggtgcgtgacgaccatggccaaaaacaaacccaccctcgacatcgagctgcagaagactgaggccacgcagttggccaccctccgaaagctatgtatagagggtaagatcaccaatgtaaccaccgactcccgctgccccacccagggggaagcgatccttcctgaggaacaggatcagaattacgtctgcaagcacacctatgtagaccgggggtggggcaacgggtgcggcctcttcggtaaaggctcgctggtgacctgcgccaaattccagtgcctggaatcgatagaggggaaggccgtccagcatgagaacctcaagtacacggtgataatcaccgtgcacaccggggaccagcaccaggtcggtaacgagacgcagggtgtgacggcagagatcacgccacaggcctcgacagtagaggcgatactgcccgagtacggcaccctggggcttgagtgcagcccacgcaccggcctggattttaacgagatgatcttacttacgatgaagaacaaggcctggatggtgcaccgtcagtggttcttcgatctaccgctaccatggaccagcggcgcgaccaccgagacacccacgtggaataagaaggagttactggtgaccttcaaaaacgcccacgctaagaagcaggaggtagttgtgctaggcagccaggagggcgctatgcacacggccctcacgggggccaccgagatccagacctccggagggacctccattttcgccggccacctgaaatgtcgcctaaagatggacaagctcgagctgaagggcatgagttacgcgatgtgtctcaacgcgtttgtcctcaagaaagaagtgagcgagactcagcacgggaccattctgataaaagtggaatataagggcgaagacgccccttgcaagatcccgttcagcaccgaggatggccagggcaaagcccacaacggtcgattgatcaccgccaaccctatagtcacgaagaaggaggagccagtgaacatcgaggcggagcctccgtttggagagtcgaacatcgtgatcggcatcggggacaaggccctgaagatcaattggtacaagaagggcagcagcatcgggaagatgtttgaagcgaccgccaggggcgcacggcgcatggctatcctcggtgacaccgcgtgggatttcggaagcgtgggcggggttctgaactccctgggcaagatggtgcaccagatcttcgggagcgcctacaccgctctcttctccggcgtaagctggatcatgaagatcggcatcggggtgctgctaacttggatcggcttaaactccaagaacaccagcatgtccttcagctgcatcgtcattgggatcatcaccctctacctgggggccgtcgtgcaggctgacatgggctgcgtgatcaactggaagggcaaggagttaaagtgcggtagcgggatcttcgtcactaacgaagtgcacacatggaccgaacaatataagtttcaggccgattcgccgaagcggctcgcaacagccatcgcgggcgcgtgggagaacggcgtgtgcggtattcgctcaactacccgaatggagaacctgctctggaagcagatcgctaacgaattaaactacattctgtgggagaacaacatcaagttaaccgtcgtggtgggggacgtcatcggcgtgctagagcaggggaagcggactctgacgccacagcccatggagctcaagtacagctggaaaacgtggggaaaggccaaaatagttaccgccgaaactcagaactccagctttatcattgatgggccgaacacccccgagtgcccctccgcgtcacgcgcttggaatgtatgggaggtcgaagactacgggttcggcgttttcactaccaacatctggttgaagctacgggagatgtacacccagctctgtgaccaccgcttgatgtcagccgccgttaaggacgaacgggccgtgcacgcggacatgggctactggatcgaatcccagaagaacggtagctggaagctggagaaagcatccctgatagaggttaagacttgcacctggcccaagagccacactctgtggtcgaatggcgtcctggagagtgacatgatcatccccaaatccctcgccgggcctatcagccaacacaactaccgacccggctaccacacccagactgccgggccgtggcacctgggcaaacttgaactcgacttcaactattgcgaggggacaacggtggtgataaccgagaactgcggcacccggggcccctccctgcgcaccactacagtcagcggtaagctgatccatgagtggtgctgccgctcctgcacattgccgccgctccgctacatgggtgaagacgggtgctggtacggcatggagatccggccgatcaatgagaaggaggagaatatggtcaagagccttgtgtcggcaggaagcgggaaggcggataacttcaccatgggcgtgctgtgtttagccattttgttcgaggaggttatgcgggggaagttcgggaaaaagcacatgatcgccggggccctcttcaccttcgtgctgctgttaagtggccagatcacatggcgagacatggcccacaccctgatcatgatcggaagcaatgcctccgataggatggggatgggcgtaacctacttggcattgatagccacgtttaagattcagccctttctggccctggggttctttcttagaaagctgaccagccgcgagaacctgcttctgggggtgggcctggccatggctaccaccttacagctgcccgaggacatcgagcagatggccaacggtatagccctcggcctcatggcccttaagctcattacgcagttcgaaacttaccagctatggacagcgctcgtctccctgatgtgctccaacaccatcttcacgctcaccgtcgcatggcgtaccgccacactgatcctggccgtgatcagccttcttcccgtgtgccagtcctcgtccatgcgaaagacggactggctgccgatgactgttgccgcgatgggggtaccgcccctcccccttttcatcttcagcctcaaagacaccctaaagcggcgatcctggccgcttaacgagggagtcatggccgtggggctcgtgagtatcctcgcctcctctttcctacggaacgatgttcccatggccggccccctggttgccggagggctgctgatcgcgtgctacgtgatcaccggcactagcgccgacctgaccgtcgagaaggcagccgacgtgacctgggaggaggaggcggaacagaccggggtgagccacaacctcatgatcacggtcgacgacgacggcacgatgcggatcaaggatgacgagaccgaaaacatccttaccgtgctgctcaaaaccgctctactgatcgtgtcagggatcttcccgtatagcatccctgccacgttactggtgtggcacacctggcagaagcagacccagcgcagtggcgtgctgtgggacgttcctagcccacccgagacacagaaggccgaactcgaggagggggtctaccggatcaaacagcagggtattttcggcaagacccaggtgggggtgggcgtccagaaagagggcgtgtttcacactatgtggcacgtgacacgcggcgccgttctgacacacaatggtaaacggttagagcctaattgggcgaacgtgaaaaaggatctgatttcctacggcggcgggtggaaactatcagcccagtggcagaagggagaagaggtgcaagtcatcgcggtggaaccagggaagaaccctaagaacttccagaccatgcccggcatcttccaaaccaccacgggcgagataggggctatcgctctggactttaagccgggcacatctgggtcccccatcatcaaccgcgagggtaaggtggtaggcctgtatgggaacggggtggtgactaagaacggaggctacgtaagcgggattgcgcagaccaacgcagagcccgacggcccaacccccgaactcgaggaggagatgttcaagaagcggaacctgacgattatggatctacaccctggcagtgggaagacccgcaagtatctccccgccatcgtacgggaagccatcaagcgtcggttgcgcaccctgattctcgcaccgacccgggtggttgcggccgagatggaggaggccctgaagggtctgcccatccgctaccagacgaccgccaccaagagcgagcacaccggtcgggaaattgtggacttaatgtgccatgctacgttcaccatgaggctgctatcccctgtgagagtccccaattataatctcatagtgatggatgaagcgcacttcaccgatccggccagcatcgccgctcgcggatatatctccacccgggtcgggatgggcgaagctgccgcaatctttatgacggccacaccacccggcaccgctgacgccttccctcagagcaacgccccgatacaggacgaggagcgcgacatccccgagcggtcctggaactcagggaacgagtggatcacggacttcgccggcaagacggtatggttcgtgccctccataaaagccggcaacgacatcgcaaattgcctccggaaaaacgggaaaaaggtgatccagctgagccgcaaaacatttgacacggagtaccagaagaccaagctcaacgactgggacttcgttgtgacgaccgatatctccgaaatgggggcgaacttcaaagccgaccgggttatcgacccccgccgttgcctcaagccggtcatcctgaccgacggcccggaacgcgtgatcctcgccggcccgatgcctgtgacggtcgccagcgctgcgcaacggcgggggcgggtgggccgcaatccgcagaaagaaaatgaccagtacatcttcacggggcaacccctgaacaatgatgaggaccacgcacactggaccgaggctaagatgcttttagataacatcaatacccccgagggcatcatccccgctctcttcgagccagagcgggagaagtccgcggcgatagacggtgagtatcgcttaaagggcgagtcgcggaagaccttcgtcgagctaatgagacggggcgacctcccggtctggctggcccacaaagtggcctctgagggcatcaagtacaccgacaggaagtggtgcttcgatggcgagcggaacaaccagatcctcgaggagaacatggacgttgagatatggacgaaggaaggggagaagaagaagctgcgccccagatggctggacgcacgtacctacagcgaccccctcgcgttaaaggagttcaaagacttcgcggccggacggaagtccatcgccctggacttagttaccgaaatcggccgtgtgccgtcgcacctggcccaccgtacccggaatgccctagataatctcgtcatgctgcacacgtccgagcacgggggccgcgcctaccgccacgccgtggaggagctgcctgagaccatggagaccctcctgctcctcgggctcatgattttgttaacgggcggagccatgttgtttctgatcagcgggaagggaattgggaagacgagcatcggcctaatctgcgttgtcgcctcgtctgggatgctgtggatggcggacgtgcccctgcagtggattgcctctgccatcgtgctcgagtttttcatgatggtcttgctgatcccggaacccgagaagcagcgcacgccccaagataaccagttggcgtatgtagtgatcggcatccttactctggccgccatagtcgccgccaatgaaatggggttactggagaccacgaagcgggatcttggaatgagcaaggagcccggcgtggtgtcgccgaccagctacctagatgtggacctgcaccccgcttccgcttggaccttgtacgccgttgcgactacggtgataacacccatgctccgccacaccatcgagaacagtaccgcaaacgtctccttagccgcgatcgccaatcaagctgtcgttctgatggggctcgacaagggctggccaatcagcaaaatggacctgggggtaccgctgctcgccctgggatgctactcccaggtaaatcctctgacgctcaccgccgcggtgctgctgctcgtcacccactatgccatcatcggcccaggtttgcaggccaaagcgacccgggaggcccagaaacgcacggctgcagggatcatgaagaaccccaccgtggacgggatcatgaccatcgacctggacccggtgatctacgatagcaagttcgagaaacagctcggccaggtcatgctgctggtcctctgtgccgtacaactgctgctcatgcgaaccagttgggccttctgcgaggcgctgacgctggctaccggacccatcaccaccctctgggaagggagccccggcaagttttggaacacgaccatcgccgtctccatggccaacatattccgcgggagctacctggccggagcggggctggccttctccattatgaagtccgtgggcaccgggaagcggggcacaggctcgcagggggagacactgggcgagaagtggaagaagaagctcaaccagcttagccggaaagagttcgacctgtacaagaagtccgggatcaccgaggtggaccggaccgaggccaaagaaggcctgaagcgcggggagatcacccatcacgctgtatccaggggcagtgctaagctgcagtggttcgtggagagaaacatggtgatcccagaggggcgggtcatcgacctcgggtgcggacgcgggggctggtcgtactactgtgcggggctgaagaaggtaaccgaggtgcggggctacacgaagggcgggccgggccacgaggagcccgtcccaatgagcacctacggatggaacatcgttaagttaatgtccggaaaagacgtattctacctcccgccagagaagtgcgacaccctgctatgcgacatcggtgagagcagtcccagccctaccgtcgaggagtcccgcactatccgggtgttgaagatggtggagccttggctcaagaataaccagttctgcattaaagtccttaacccctacatgcccaccgtgatcgaacacctggaacgcctccaaagaaagcacggcggcatgcttgtccgaaacccactgtccaggaactccacccacgaaatgtactggatcagcaatgggaccggaaacatcgtctcaagcgtgaatatggtgtcccggctcctgctcaatcgcttcacgatgacccatcggaggcccaccatcgaaaaggatgtggacctcggagctggaacccggcacgtgaacgctgaacccgagacgcccaatatggacgtcatcggcgaacgaatcagacgaatcaaggaagaacacagctcgacctggcactatgacgacgagaacccgtacaagacctgggcctaccatgggagctacgaggtgaaggcgactgggtccgctagctctatgatcaacggggtggtaaagttgttaacgaagccgtgggacgtggtgcccatggttacgcagatggccatgaccgacaccacgcccttcggccagcaacgggtcttcaaagagaaggtagacacacgcacgccccgcccaatgcccgggacccgtaaagtgatggagatcacagccgaatggctctggcggacgcttgggcgcaacaagcggccccgcctgtgcacccgtgaggagttcatcaagaaggtgcgcaccaacgccgcgatgggggcggttttcacggaggagaaccagtgggacagcgcccgcgccgccgtcgaggacgaggagttctggaaactcgtggaccgtgagcgcgagctgcacaagctcgggaagtgcggtagctgcgtgtacaacatgatgggcaagcgggagaagaaactcggcgagttcgggaaggcgaagggctcgcgcgcgatatggtacatgtggctgggcgcaagatacctcgagttcgaggccctcggcttcctgaacgaagaccactggttctcgcgcgagaacagtcacagtggcgtcgagggggagggcctacacaagctggggtacatcctgcgggacatctccaagatccctggaggggccatgtatgcggacgacaccgctgggtgggacacccgcatcaccgaggacgatctgcataacgaggagaagattacgcagcagatggatccggaacaccggcagctcgcgaacgcaattttcaagctgacgtatcaaaacaaagtggttaaggtccagcgcccaacccccaaggggaccgtgatggacattatcagccggaaagaccagcgagggtcgggccaggtaggcacgtacgggctgaacacattcaccaatatggaagcccagctcatccggcagatggaaggcgagggagtactgagcaaggcggacctagagaaccctcacctcctggagaagaaagtgactcagtggctggagacgaaaggcgtggagcgcttgaagcggatggccatctccggggacgactgtgtcgtaaagccgatagacgaccgtttcgccaacgccctgctcgccctcaatgacatgggcaaagttcgtaaagacataccccagtggcagcccagcaaggggtggcacgactggcaacaggtccccttctgctcccaccactttcatgaactgattatgaaggacgggcgcaagctagtcgtgccgtgccgcccccaggatgagctcatagggcgggcgagaatctctcagggagcaggctggtcgctccgcgagacggcttgcctgggcaaggcttacgcgcaaatgtgggctctcatgtacttccatcgccgggacttacgcctggccagcaatgcaatatgctctgccgtacccgtgcactgggtgccaacgagccggaccacctggtccattcacgcccaccaccagtggatgactacagaggacatgctcaccgtctggaacagggtctggatcgaggacaacccgtggatggaagacaagacccccgtgacgacctgggaagacgttccttacctgggtaagcgagaggaccagtggtgcggcagtctgatcgggctcacaagtagggcaacctgggcccagaacatcctaaccgccatccagcaagttcggagcctgatcggcaatgaagagttcctcgactacatgccaagcatgaagcgctttaggaaggaggaggagtccgagggcgctatatggtga

SEQ ID NO: 26179 - RNA, 9873 nt, synthetic construct
  misc_feature 1..9873: note = derived and/or modified CDS sequence (opt11) from DENV-3__JQ920488__SS-prME
  source 1..9873: mol_type = other RNA
acttcgctgtgtctgatgatgatgttacccgctactctggccttccacctcaccagccgagacggagaaccccggatgatcgtgggcaaaaacgaacggggcaagagcctgctgttcaagaccgcctccggcatcaacatgtgcacattgatcgcgatggacttgggcgaaatgtgcgacgacaccgtaacctacaagtgccccctgatcactgaagtcgaacccgaggacatcgactgctggtgtaacctcaccagcacctgggttacgtacgggacttgcaaccaggcaggggagcaccgacgagacaagcgctccgtggcgttggcgcctcacgtaggcatggggctggacacccgcacacagacgtggatgagcgcggagggcgcctggcgccaggttgaaaaggtcgagacctgggcatttcgccaccccggattcacgatcctcgccctcttcctggcacactacattggcacctccctcacgcagaaagtcgtgatcttcatcttgctgatgctcgtcacacccagtatgaccatgcggtgcgtgggggttggcaaccgcgacttcgtcgagggcctttcgggagccacctgggtggatgtggtcctggagcacggcggatgcgtaacgactatggccaaaaacaagcccacgctcgacatcgaactgcagaagactgaggcaactcagctggccacactccggaagctgtgtatcgagggcaaaatcacaaacgtgaccacggacagccgctgcccgactcagggcgaggcaattctgcccgaggagcaggaccaaaactacgtctgtaagcacacctacgtggaccgggggtggggcaatgggtgcggtctcttcggcaaggggtccctggttacctgcgccaagttccagtgcctggagagcatcgaaggcaaggctgtccagcacgagaacctcaagtacacggtgatcatcaccgtacatacaggggaccagcatcaggttggcaacgagacccagggggtgacggccgagataacaccccaggcctccaccgtcgaggcaatattgcccgagtacggcaccctggggctcgagtgcagcccccgcaccggcctggacttcaacgaaatgatcctgctcacgatgaagaataaggcctggatggtgcaccgacagtggttctttgaccttccgctgccatggacgtccggcgccaccacagagacgcctacctggaacaagaaggagttactggtgacttttaagaacgctcatgctaagaagcaggaggtcgtggtgctggggagtcaggagggggcaatgcacaccgccctcacgggtgccaccgaaatccagacttcgggcgggaccagcatcttcgctggccatctgaagtgtcggcttaagatggacaagctcgagctgaagggcatgtcctacgccatgtgcttaaacgcgtttgtactcaagaaggaggttagcgagacgcagcacgggaccattctgatcaaggtggagtacaagggcgaggacgccccctgtaagattccctttagcactgaggacgggcagggcaaggcacacaacggacggcttatcaccgccaaccccatcgtcacgaagaaggaggagcccgtgaacatagaagctgagccaccgttcggggagtccaacatcgtgatcggcatcggggacaaagccctgaagatcaactggtacaagaaggggtcatccatcgggaagatgtttgaagccaccgccaggggcgcccggcgcatggcgatcctcggcgacaccgcatgggacttcgggagcgtcggcggggtgctgaactccctgggcaagatggtacaccagatcttcggcagcgcctacaccgccctcttctccggcgtcagctggatcatgaaaatcggcataggggttctgttgacgtggatcggcctcaactctaaaaatacaagcatgtccttcagctgcattgtgatcgggatcatcaccctttacctgggcgctgtcgtgcaggcggatatggggtgcgtgatcaactggaaggggaaggagctcaagtgcggtagcgggatcttcgtgaccaacgaggtgcacacgtggaccgagcaatataagttccaggccgacagccccaagaggttggccaccgcaatcgcaggcgcgtgggagaacggggtgtgcggcatcaggtccaccacgaggatggagaatctgttgtggaagcagatcgccaacgaactgaactacatcctgtgggagaataatatcaagctcactattgttgtaggcgatgtgatcggggtcctggagcagggtaagcggaccctgacgccccagcccatggagctcaagtactcatggaagacgtgggggaaggccaagatcgtgaccgccgagacccagaactccagctttatcatcgacggccctaacacccccgagtgtccatccgcgctgcgcgcttggaacgtgtgggaggtcgaggactatgggttcggcgtgtttacgacgaacatctggttaaaacttcgagagaagtacacccagctgtgtgaccaccgtctgatgagcgcagccgtgaaggacgaacgagcggtccatgccgacatgggctactggatcgagagccagaagaacgagtcctggaaacttgagaaagctagcttgatcgaggtgaaaacatgcacctggcccaagtctcatacgctatggagcaacggggtcctagaatccgacatgatcatcccaaagagcctggcgggccctatctcccagcacaactaccgcccggggtaccacacccagaccgccggcccgtggcacctggggaaactcgagctggactttaactactgcgaaggcaccacggtagtgatcaccgagaactgcggcatccgggggccctcgctgcgcaccaccacagtgtccggcaaactcatccacgaatggtgctgccgtagctgtaccctgccgcccctgcgctacatgggggaggacgggtgctggtacgggatggagatcaggccgatcaacgagaaggaagagaatatggtcaagtccttggtgtctgccggctccggcaagaccgacaatttcaccatgggggtactgtgcctggcgatcctcttcgaggaggtaatgcgcggcaagttcgggaaaaagcacatgatagccggcgccttgttcacgttcgtgctgttactgagcggtcaaatcacatggcgggacatggctcacaccctgatcatgatcggctccaacgcaagcgaccgcatgggcatgggggtaacctacctcgctctaatcgcaacattcaagattcagcccttcctagccctcggcttctttctgaggaagctgacctcccgtgagaatctcctgctgggggtaggcctggccatggctaccaccctgcagctgcccgaagacatcgaacagatggctaacgggatcgcccttgggttgatggccctgaaactaatcacgcagttcgaaacctatcaactctggaccgccctgatcagcctcatgtgttccaacacgatcttcacgctgaccgtggcgtggcggaccgccaccctgatcctcgctgtgatctccctactgcccgtctgccaaagctcaagcatgaggaagacggactggctcccgatgaccgtggccgccatgggtgtgccgcccctgcccctgttcatcttttccttgaaggacaccctgaagcgacgtagctggccgctgaacgagggggtcatggccgtgggcctcgtttccatcttagcaagctccttcctgcgcaacgacgtgcccatggccgggcccctcgtggccggcgggctactgatcgcctgctacgtcatcaccgggacgtcagccgacctcaccgtggagaaggccgccgacgtaacctgggaggaagaggccgagcagactggcgtctcccacaacctgatgatcacggttgatgacgacggcaccatgcgtataaaggacgacgagaccgagaacatcctgaccgtgctcctgaagacggccttactcatcgtctcgggcatcttcccctactcgatcccggcgactctgctggtgtggcacacctggcagaagcagacccaacgcagcggcgtgctctgggacgtgccgagcccgcctgagacccagaaggccgagttagaggaaggcgtgtaccggatcaagcagcagggcatcttcgggaagacccaggtgggtgtcggggtgcaaaaggagggcgtattccacaccatgtggcacgtcacaagaggggccgtgctgactcataacggcaaacggcttgagccgaactgggcaaacgtgaagaaggacctgattagctacggaggaggctggaagttaggggcgcagtggcagaagggcgaggaggtccaagtgattgccgtggagccggggaagaaccccaagaactttcagacgatgcccggaatctttcagaccaccactggcgaaatcggggccatcgccctggacttcaagccgggcacgtccgggtctcccatcatcaacagggagggcaaggtcgtgggcctctatggcaacggcgtggtcaccaagaatgggggctacgtgtccgggatcgcccagaccaacgcggagcccgacggtccgaccccggagctggaggaagaaatgttcaagaagcggaatctgacgatcatggatctccaccccggcagtggaaagacccgcaagtacctacccgctatcgtgcgggaagctatcaagcgccggctgcgtacgctcatcctggcccctaccagggtcgtggcagcggagatggaagaggccctgaagggcctccccatcagataccaaacgaccgccaccaagagcgagcacaccgggcgggagatcgtggacttgatgtgccacgccacgttcaccatgcgcctgctctccccagtccgggtgcccaattacaacctgatcgtgatggatgaagcccactttaccgatccggcgtccatcgccgcccgcggctacatctctacccgcgtcgggatgggcgaagcagcggccattttcatgactgcgacgccgcccggcacagccgacgccttcccccagagcaacgctccgatccaggacgaggagcgcgacatccctgaacggtcctggaacagcggcaacgagtggatcaccgatttcgccggaaagacggtgtggttcgtgccctccatcaaggcagggaatgacatcgccaactgtctgagaaagaatggcaagaaagtaatccaactcagcaggaaaacgttcgacaccgaatatcagaagaccaagctgaacgactgggacttcgtggtgacgaccgacatttccgagatgggtgccaactttaaggcggaccgggtcattgacccacggcggtgcctgaagccagtgatcctcaccgatggacccgagcgagtgattctggccggccccatgcccgtcaccgtggcctctgctgctcagcggcgagggcgggtgggccgtaactcccagaaggagaacgatcagtatatctttacagggcagccgctaaacaacgacgaggaccatgcgcactggaccgaggccaaaatgctcctggacaacatcaatacccccgagggcatcatccccgccctgttcgaaccagagcgggagaagtccgccgccatcgacggtgagtaccgccttaagggcgaatcccggaagaccttcgtcgaacttatgcgccggggcgatctaccggtctggttagcccacaaggtggccagcgagggaatcaagtacaccgacagaaagtggtgctttgatggagagcggaacaaccagatcctggaggagaacatggacgtagagatctggacgaaggagggggaaaagaagaagctgcgcccccggtggctcgacgcccgcacctactcggaccccctggcactgaaagagtttaaggacttcgcggccggcagaaagtctatcgcactggatctggtaaccgagatcggccgcgtcccctcccacctggcccatcgcacccggaacgccctcgacaatctggtgatgctgcacacgagcgagcacggtggccgcgcgtaccggcacgccgtcgaggagctcccggagaccatggagactctactgcttctggggctgatgatcctccttaccggtggagccatgctgtttctcatttccggcaagggcatcgggaaaacgagcataggcctgatctgcgtcgtcgccagctccggcatgctgtggatggccgacgtgcccttgcagtggattgcgagcgccattgtcctggaatttttcatgatggtgctcctcatccccgagccggagaagcagcgcacgccccaggacaatcaactggcctacgtggtcatcggcatcctgacactcgccgccatcgtggcggctaacgagatgggactgctggagaccacgaaacgggatctcggcatgtccaaggagcccggcgtggtcagccccacctcctacctggatgttgatctgcatccggctagcgcctggaccctctatgcggtggctaccacggtaatcacgccgatgctgcgccatacaatcgagaactccacggccaatgtgagcctggccgccattgcgaaccaagccgtggtactcatggggctggacaaaggctggcccatctccaagatggatctgggggtgcccctcctggccctgggctgctactcccaggttaaccccctcacgctgaccgccgccgtcctcctgctggtgacgcactacgcgatcatcgggccgggcctgcaggccaaggccacccgcgaggcccaaaagcgcacggcggcgggcatcatgaagaacccaaccgttgatggtatcatgaccatcgacctcgaccccgtgatatatgactccaagtttgagaagcagctgggacaggtgatgctgcttgtgctgtgtgccgtccagctgcttctgatgcggacaagctgggccttctgcgaggccctgactcttgcgaccgggccgatcaccaccctgtgggagggctccccgggcaagttctggaacacgacaatcgccgtgtcaatggccaacatcttccgcgggagttacctggccggcgccgggctcgcgttcagcatcatgaagtccgtgggcaccgggaagcgcggcaccggcagccagggggagacgttaggcgagaaatggaagaagaaactgaaccagctctccagaaaggagttcgacctgtacaagaagtccgggatcaccgaagttgaccggactgaggccaaggaaggtctgaagcgcggggagattacacaccatgccgtgagccggggctccgccaagctccagtggttcgtggaacgcaacatggtgatccccgagggtcgggtgatcgacctgggttgcggccgtgggggatggagctattactgcgccgggctaaagaaggtgaccgaggtacgaggctacacgaagggcgggcccggccacgaggaacccgtgcccatgagcacctacgggtggaacatcgtgaagctcatgagcggcaaggacgtgttctacctgcctcccgagaaatgtgacaccctgctgtgcgacataggggaatccagcccttccccaaccgtggaggagagccgcacgatcagggtgctcaagatggtcgagccgtggctaaagaacaatcagttctgcatcaaggtgctgaatccctacatgccgaccgtgatcgagcacctcgagcgcctgcagcgcaagcacggcggcatgctggtccgcaaccccttatcccgcaacagcacccatgagatgtactggatctcgaatgggaccggtaacatcgtgagcagtgtgaacatggtcagtcggttactgcttaatcgcttcacgatgactcaccggcgccccaccatcgagaaggatgtggacctgggggcggggaccagacacgtgaacgcggaacccgagacgccgaacatggacgtcatcggcgagcgcatacggcgcataaaggaggagcactctagcacctggcactacgacgacgagaacccctacaagacctgggcatatcatgggtcctatgaggtgaaggccaccggcagcgcatccagcatgatcaacggggtggtaaagctgctgacgaagccctgggacgtggtacctatggtgacccaaatggccatgaccgacaccacgcccttcggccaacagcgtgttttcaaggagaaagtcgacactcggacgcctcggcctatgccggggacccgcaaggtgatggagatcaccgctgagtggctgtggcggaccctgggccgcaacaagcggccccgcttgtgtacgcgcgaggagtttatcaagaaagtgcgcactaacgcggccatgggagcagtattcacggaggagaatcagtgggatagcgcccgcgcagccgtcgaggacgaggagttctggaagctggtcgaccgggaacgcgagctgcacaagctagggaagtgcggttcctgcgtctacaacatgatggggaagcgggagaagaaactgggtgagttcgggaaggccaaaggcagccgcgcgatttggtatatgtggctgggagccaggtatttggagttcgaggccttggggttcctgaacgaggaccattggttcagtcgcgagaatagccactccggcgtggagggggaggggttacacaagctggggtacatactgagggacattagcaagatccccgggggcgccatgtacgccgacgataccgcgggttgggacacccgaatcaccgaggatgacctccacaacgaggagaaaatcacccagcaaatggaccccgagcaccggcagctggcaaacgccatcttcaagttgacctatcagaacaaggtggtcaaggtccagcgcccgacaccgaagggcaccgtgatggacatcatctcccgaaaagaccaacgcgggagcggccaggtcggcacgtacgggctcaacactttcaccaacatggaagcgcagctgatccgacaaatggagggggagggtgtgctgtccaaggccgacctagagaacccccacctcctggagaagaaggtgacccagtggctcgagaccaagggcgtcgagcgcctgaagcgcatggcgatctcgggggacgactgcgttgtgaagcccattgacgaccgcttcgccaatgctttacttgccctgaacgacatgggcaaggtccggaaggacatcccgcagtggcagccctccaagggctggcacgactggcagcaggtccccttctgcagccaccacttccatgagctgatcatgaaggacgggcgcaaactcgtagtcccctgccgtccgcaggacgagctgatcggccgcgcccggatctcccaaggggcgggatggtcgctgagggagacggcctgcctcgggaaggcctacgcccagatgtgggctctgatgtatttccaccgccgggaccttcgcctcgcctccaacgccatatgtagcgccgtgcccgtacattgggtccccacctcccggaccacttggtctatccacgcccaccaccagtggatgaccaccgaagacatgttgaccgtgtggaaccgggtgtggatcgaggacaacccctggatggaggacaaaaccccggtcacgacctgggaggatgtgccctacctgggcaagcgggaggaccaatggtgcggcagcttaatcgggctgaccagccgcgcgacctgggcccagaacatcctaaccgccatacaacaggtccggagcctcatcggcaacgaagagtttctggattacatgccctccatgaaacgcttccggaaggaggaggagagcgagggggccatatggtga

SEQ ID NO: 26180 - RNA, 9873 nt, synthetic construct
  misc_feature 1..9873: note = derived and/or modified CDS sequence (opt11) from DENV-3__JQ920489__SS-prME
  source 1..9873: mol_type = other RNA
accagcctctgcctcatgatgatgctgcccgccacgctggccttccatctcaccagccgggacggcgagccgcggatgatcgtggggaagaacgagcggggcaagtcgctgctgttcaaaaccgccagtgggatcaacatgtgcaccctcatcgctatggacctgggcgagatgtgcgacgataccgtgacctacaagtgcccgctgataacagaggtggaaccagaggacatcgattgctggtgcaacttaacatccacctgggtgacttacgggacctgcaatcaagccggcgagcaccgcagagacaagcggtccgtggccctggctccccatgtgggcatgggcctggacacccgcacccaaacgtggatgtcggcggagggcgcctggcgccaggtggagaaggtcgagacctgggcattccgacacccagggttcaccatcctcgccctcttcctcgctcattacattggcacctccctcacgcagaaggtggtaattttcattctacttatgcttgttacgcccagcatgaccatgcgttgcgtaggggtcggcaatcgcgacttcgtggaggggttaagtggggcaacctgggttgacgtggtcctagagcacggcgggtgcgtaacgaccatggccaagaacaagcccactctcgacatcgagttgcaaaagacagaggccacgcagttggccaccctccggaagttgtgcatcgaaggcaagatcaccaacatcaccacggacagccgttgcccgacccaaggagaggcaatcctacccgaggagcaggaccagaactacgtgtgcaagcatacgtacgtcgaccgcgggtggggcaatgggtgcgggctcttcgggaagggctccctcgtaacgtgcgcgaagttccagtgcctagagtcgatcgaggggaaggctgtgcaacacgagaacctgaagtacaccgtcattatcaccgtgcacactggggaccagcatcaggtgggtaacgagactcagggggttaccgcggaaatcacgccccaagcctccaccgtggaggcgattctgcccgagtacggcaccctggggctcgagtgcagtccccgcacgggcctggacttcaacgagatgatcctgctcacgatgaaaaacaaggcctggatggtccacaggcagtggtttttcgacctgccactgccctggactagtggggccaccaccgaaacgcctacttggaacaagaaggagctgctggtgaccttcaaaaatgcccatgccaagaaacaggaggttgttgtgctggggtcgcaggagggggcgatgcacaccgcattaacaggcgccaccgagatccaaacgtcgggcgggacctccatcttcgccggccatctgaagtgtcgcctgaagatggacaaacttgagctgaaaggtatgtcgtatgccatgtgcctgaatgcattcgtgctcaagaaggaagtcagcgagacgcagcacgggaccatcctgatcaaagtggagtacaagggtgaggacgccccctgcaagatcccattcagcaccgaggacgggcagggaaaggcccacaacggacggctgatcacggccaaccccatagtgacgaaaaaagaggagcccgtcaatatagaggctgagccgcccttcggggagagtaacatcgttatcggaatcggggacaaggccttgaagatcaattggtacaagaaaggcagcagcatcgggaagatgttcgaggccaccgcgcgcggcgctcggcgtatggctattctcggcgacacagcatgggacttcggtagcgtgggcggggtcctgaactcccttggaaaaatggtccaccaaatcttcgggagcgcctacaccgccttgttctccggtgtgagctggatcatgaagataggcatcggggtcctgctcacgtggataggccttaatagtaagaacaccagcatgtccttcagctgcatcgtaatagggatcatcactctgtacctcggcgcagtggtgcaggccgatatggggtgcgtgatcaactggaaaggcaaggagctgaaatgcggtagtggaatcttcgtgaccaacgaggtgcacacgtggaccgaacagtacaaattccaggccgacagtcccaaacggcttgccactgctatcgccggcgcgtgggagaacggggtgtgcggcattcggtccaccacccgcatggagaacctcttatggaagcaaatagccaacgagctgaactacatcctgtgggaaaataatatcaagctcaccatcgttgtaggggacgtgatcggtgtgctggaacaaggcaagcggaccctgacaccccagcccatggagctgaagtactcatggaaaacgtgggggaaggcaaaaatagttacagccgagacccaaaactccagcttcataatcgacgggcccaatacgcccgagtgcccctcggccagtcgcgcctggaacgtctgggaggtggaggactatggcttcggcgtgttcactaccaatatctggctgaagctgcgggagaagtacacacagctctgcgaccaccgcctaatgtctgcagccgtgaaggacgaacgtgcggtacatgcagatatgggctactggattgagtcccagaaaaacggcagctggaagctggagaaggcctccctcattgaggtgaaaacctgcacctggcccaagtcgcacacgctgtggagtaacggagtgctagagagcgacatgatcatcccgaagtcattagccgggccaatctcccagcataattaccgccccgggtaccacacccagacagccgggccgtggcacctcggcaagctggagctcgacttcaattattgcgagggaactacggttgtcataactgagaactgcggcattcgtggaccctccctgcgcaccacgacggtgagcgggaaactgattcacgagtggtgttgtcggtcctgcacactgccgcctctccgctacatgggcgaggacgggtgctggtatggtatggaaattcggccgatcaacgagaaagaggaaaacatggtaaagagcctggtctccgccggcagcgggaagacggacaacttcaccatgggggtcctctgcctggcgattctctttgaagaggtgatgcgcggtaagttcggtaagaagcacatgatcgccggggccctcttcaccttcgtcctgctgctatccggccagatcacttggcgggacatggcccacaccctaatcatgataggaagcaacgcctccgaccgcatggggatgggggtaacctacctagcgttgatcgccacctttaagatccagcccttcctcgcactagggttcttcttacggaaacttacctcacgcgagaacctgctactgggcgtgggcctagccatggcgaccaccttacagttacccgaagacatcgagcagatggccaatgggatcgcactggggctgatggccctgaaattgataacgcaattcgagacctaccaactctggaccgctctgatttcgctgatgtgttccaacaccatcttcaccctcacagtcgcctggagaaccgctaccctgatcttagctgttattagcctcctgcccgtctgccaatccagctccatgagaaagacggactggctgcccatgaccgtcgccgccatgggggtcccccccttacccctgttcatattctccctaaaggataccctcaagaggcgatcttggccgctaaacgagggggtgatggcggtcgggctggtgtcgatcttagcctccagctttctgcgcaatgacgtaccaatggccggcccactggtggccgggggacttctgatcgcctgttacgtgataacaggcacgtccgctgatctgactgtggagaaggcggccgatgtcacctgggaggaagaggcagagcagaccggcgtgtcccacaatctcatgataacggttgacgacgatgggaccatgcgaatcaaggacgacgaaacagagaacatattaaccgtcctactaaagaccgccctgctgatcgtttccgggatcttcccctactcaatcccagcgaccctcctagtttggcacacctggcagaagcagacccagcgctccggcgtgctatgggacgtaccaagcccgccagagacccagaaggccgagctcgaagagggggtctaccggatcaagcagcagggtattttcgggaaaacccaagtcggcgtgggcgtccaaaaggaaggggtgtttcataccatgtggcacgtaacccgcggtgccgttttaacacataacgggaagagactggagcctaactgggccaacgtcaagaaggaccttatctcctacggcggcggatggaagctgagcgcgcagtggcagaaaggtgaggaggtgcaggtcatcgcagtggagcccgggaagaaccccaaaaactttcagacgatgcccggcattttccagacgaccactggcgagatcggcgcgatcgccctagactttaaacccggaacgagcgggagccccatcattaatcgcgagggaaaggtggtcggcctttacgggaacggcgtggtgaccaagaacggcgggtatgttagcggcatagcccaaactaacgcggaacccgacggcccgacccccgagctcgaagaggagatgttcaagaagcggaatcttactattatggacttgcaccccggctccgggaaaacccgcaagtacctccccgctatagtgcgggaggccataaagcgccggctgcgaaccctgatcttggcgccgacccgggtggtagccgcggagatggaggaggccttaaaggggcttcccattcgctaccagacgaccgccactaagtccgaacacaccggtagggagatagtcgatctcatgtgtcatgctacgttcaccatgcgcctcctgagtcctgtgcgcgttccgaattataacttaattgtcatggacgaggctcacttcaccgacccggccagcatcgccgcccgcggctacatatctactcgggtcgggatgggcgaggccgcggccatcttcatgaccgccaccccgcccggcaccgccgacgccttcccccagagcaacgcgcccatccaggatgaagagcgcgatatcccggagcggtcctggaacagcgggaacgaatggatcaccgattttgcaggaaagacggtgtggtttgtcccttccatcaaggcggggaacgacatcgccaattgcctgcgcaagaacggaaagaaggtgatccagttaagcagaaaaactttcgatacagagtaccagaagaccaagctcaacgactgggactttgttgttacgaccgacatttccgagatgggtgccaacttcaaggcggaccgcgtgatcgacccccgccgctgcctaaagccggtcatcctgaccgatggccccgagcgggttatcctcgccggcccgatgcccgtaacagtcgccagcgccgcgcagcggagaggaagagtcggcagaaattcccagaaggagaacgatcagtacatcttcactggacaaccgctaaacaacgatgaggaccacgcgcactggaccgaggccaagatgcttctcgacaatatcaacacgcctgaggggataatccccgccctgtttgagccggaaagggagaagtcagccgcgatagacggggagtacagactaaagggcgagtctcggaaaaccttcgttgagctgatgcggagaggagatctaccggtctggctggcccacaaggtcgccagcgaggggataaaatacacagaccgcaagtggtgcttcgacggggagcggaacaaccagatcttagaggagaacatggacgtggaaatctggacgagagagggagagaagaagaagctgcggccgcgatggttggacgcgcggacctactccgacccgctcgctctaaaggagttcaaggatttcgcggccggccgtaagtcgatcgccctggatttggtcactgagatcggccgagtgccctcccacctggcgcaccggacccgcaatgccctcgacaacctggtcatgctgcatactagcgagcacgggggccgggcgtaccggcacgcggtggaggagctgccggagactatggagaccctcctgctgctcgggctaatgatcctgctcactgggggtgctatgttgtttctaatcagcgggaagggcatcggtaagacgtctatcggcctcatctgcgtcgtcgcaagctccgggatgctgtggatggccgatgtcccccttcagtggatcgcttcagccatcgtcctcgagttcttcatgatggtcctgctgatccccgaacctgagaaacagcggactcctcaggataaccaactggcctatgtggtgatcggtatcctgaccctggcagccatcgtcgcggccaacgagatggggctcttagagaccacgaagcgcgacctgggcatgtccaaggagcccggtgttgtgtctccgacctcctacctcgacgttgacctgcatccggcctccgcatggacgctgtatgctgtggccaccacggtgatcactcctatgctccggcataccatcgaaaacagtacagccaacgtcagccttgcagccattgcgaaccaggccgtggtgctgatgggtctcgacaaggggtggcccatttccaagatggacctaggggtccccctgctcgccttgggctgttatagccaggtgaatccactgacgcttaccgcggccgtgctgttactagtcacgcattacgcaataatcgggccaggcctgcaagctaaggccactcgcgaagcccaaaagcggacggccgctggtataatgaagaaccccactgtggacgggatcatgaccatcgacttagaccctgtaatctacgactccaagttcgaaaagcagctgggccaggtcatgctgttagttctctgtgcggtgcagctgctgctcatgcgtactagctgggccttctgcgaagcccttactctggcgactgggccgatcacaaccctctgggagggctcgcctggcaaattctggaacacgaccatcgccgtcagcatggccaacatcttccgggggtcctacctcgccggcgccggactagcgttctcaatcatgaaatcagtaggcaccgggaaaagaggcaccggtagccagggggagacgctcggtgagaaatggaagaagaaactgaaccagctgtcaaggaaggagttcgatctctataagaaatccgggataactgaggtggaccgtatcgaggccaaagagggcctgaaacgcggggagataacccatcacgccgtttcgcgcggctccgccaagcttcaatggttcgtggagcgtaatatggtgatcccagagggtcgcgtcatcgacctcgggtgcggacgcggaggatggtcatactactgcgccgggctgaagaaggtgactgaagtgcggggatacactaagggcgggcccggccatgaggagccggtacccatgtcgacctacgggtggaatatcgtgaagctgatgagcggcaaggacgtgttctacctgccacccgagaagtgcgatactctgctgtgcgacatcggggagtccagcccgtcgcccacagtcgaggagagccggaccattcgcgttttgaagatggtggagccctggctcaagaacaaccagttctgcatcaaggttctaaacccgtatatgccgacggtgatcgagcacttggagcgcctccagcggaagcatggcggcatgctggttcgcaaccccctgtccagaaacagcacccacgagatgtactggatctccaatggaactggcaatatcgtcagctccgtgaacatggttagccgcttgctgctgaaccggttcaccatgactcaccgccggcctacgatcgagaaggacgtcgacctcggtgcgggtacccgtcacgtgaacgccgagcccgagacccccaacatgaacgtgataggcgagcggatcagacggatcaaagaagagcacagtagcacttggcactacgacgacgaaaacccgtataagacctgggcgtaccatgggtcctacgaggttaaagctaccggctcagccagctccatgatcaacggagtggtaaaactactgaccaagccatgggacgttgtgcctatggtcacgcagatggcgatgaccgacaccactcccttcggccagcagcgtgtgttcaaggagaaagtggacacgcgaacgccccggcccatgccggggaccaggaaggtcatggaaatcaccgccgagtggctatggcgcacgctgggcagaaacaagcgcccccggctatgcacccgagaggagtttatcaagaaggtgcgcaccaacgccgccatgggtgcggtgttcactgaggaaaaccagtgggacagtgcccgtgccgcggtcgaggacgaggagttctggaaattggttgaccgcgagcgcgagttgcacaagcttgggaaatgcggctcctgcgtgtacaacatgatgggaaagcgcgagaagaaactcggggagttcggcaaagccaagggcagtcgggccatatggtatatgtggctgggcgcccggtacttggagttcgaagctctcgggttcttaaatgaggatcactggttcagcagagagaatagccactcgggcgtggagggagagggcctgcacaagctggggtacatcctgcgcgacatcagcaagattccaggcggcgccatgtacgccgacgacacggcggggtgggacacccggattactgaggacgacctgcacaacgaagagaagatcacgcaacagatggatcctgagcaccgccagctcgctaacgccatttttaagttaacgtaccagaacaaagttgtgaaggttcagagaccgacccccaagggcaccgtaatggacatcatcagtcgcaaagaccaacggggcagcgggcaggtgggcacctacggtctgaacacgttcacaaacatggaagctcagctcatccgacagatggagggagagggtgtcctctccaaagccgacttggagaacccacaccttctggagaagaaggtaacccagtggctggagaccaagggcgtcgagcgcctcaagcgtatggcgattagcggggacgattgcgtcgtgaagcccatcgacgaccggtttgccaatgccctgctggcactcaacgatatgggcaaagtgcgcaaggacattccgcaatggcagccctccaagggctggcacgactggcaacaagtccctttctgctcacaccacttccatgagctaatcatgaaggatgggcggaagttagtggtcccgtgccgccctcaagacgagctcatcggccgggcccgcatatcccaaggggcgggttggagcctaagggagactgcctgccttgggaaggcctacgcccagatgtgggcgctaatgtacttccaccgccgagacctgcggctggcctccaacgccatatgcagcgccgtccccgttcactgggtacccacgagccgcaccacctggagcatccatgcccatcaccagtggatgaccacggaggacatgctcaccgtgtggaacagggtatggatcgaggataacccgtggatggaggacaagaccccagttacgacttgggaggatgtgccctaccttggcaagagggaggatcagtggtgcggcagcctgatcgggttaacctcccgtgcgacctgggcccagaacatattgaccgccatccagcaagtcaggagcttgatcgggaacgaggagtttctcgattacatgccctccatgaagcggtttcgcaaggaggaggagagcgagggtgcaatctggtga

SEQ ID NO: 26181 - RNA, 9873 nt, synthetic construct
  misc_feature 1..9873: note = derived and/or modified CDS sequence (opt11) from DENV-3__KF824902__SS-prME
  source 1..9873: mol_type = other RNA
actagcctgtgcctcatgatgatgctgcccgccaccctcgccttccacctcacgtcccgcgacggcgagccgcggatgatcgtgggtaagaatgagcgcggcaagagcctgctgtttaagaccgcgtccgggatcaacatgtgcaccctgattgccatggatctgggcgagatgtgtgacgacaccgttacctacaagtgccccctgatcgccgaggtggaaccggaggacatcgactgttggtgcaacctaaccagcacttgggttacttacgggacttgcaaccaggccggcgagcaccggcgcgacaagcggtccgtcgctctggcgccccacgttggaatggggctggacacccggacccagacgtggatgagcgccgaaggcgcctggcgtcaggtggagaaggtcgagacctgggccctccggcacccggggttcaccatcttggcgctgttcctcgcccactacatcggcacctccctgacccagaaggtggtgatcttcatcctgcttatgctggtcaccccctccatggccatgcggtgtgtgggggtgggcaaccgcgacttcgtcgagggcctgtccggggccacctgggtggacgtggtccttgagcacggcgggtgcgtgaccacgatggccaagaacaagccgacgctggacatcgagcttcagaagaccgaggcgactcagctcgccaccttgcggaagctgtgcatcgagggtaagatcacgaacatcaccacggacagtcgctgtcccacccagggcgaagccatcctcccggaggagcaagaccagaactatgtttgtaagcatacgtatgtcgaccgtgggtggggcaacgggtgcggcttattcggcaagggttccctggtaacctgcgccaagttccaatgtttagagagcatcgagggcaaggtggttcagcacgaaaacctgaagtacaccgtcaccataaccgtgcacacgggggaccagcaccaggtcggtaatgacactcagggggtgaccgcagagataactccccaggcgagcaccgtggaggccatcctgccggagtacggcaccctcgggctggagtgctcgccgcgtaccggcctggacttcaacgagatgatactccttacaatgaagaacaaggcgtggatggtgcaccgtcaatggttcttcgacctgccgctcccctggacgtccggcgctaccaccgagacccccacgtggaacagaaaggagctgcttgtgaccttcaagaacgcccacgcgaagaagcaggaggtagtggtgctcggctcgcaagagggcgccatgcacaccgcactgacaggcgccacggagatccagaactccggcgggacctccatcttcgccggtcatctaaagtgccggctcaagatggacaagctggagctcaagggcatgtcctacgcgatgtgcctcaacacctttgtcctgaagaaggaagtgagcgagacccagcacgggacgatcctgatcaaggtggaatacaagggtgaggacgccccctgcaagataccgttcagcaccgaggacgggcagggcaaggcccacaacggcaggctgattaccgccaaccccgtcgttaccaagaaggaggaacccgtaaacatcgaggcggagcccccgttcggcgagagtaacatcgtcatcggaatcggggacaaggccctcaaaattaactggtacaagaagggcagctccatcggaaagatgtttgaggccacagcccggggtgctcgccggatggcgatactgggcgacaccgcctgggacttcgggagtgtaggcggggtgctgaacagtctcggcaaaatggtccaccagatcttcgggtccgcatacaccgcgctgttcggcggcgtcagctggatcatgaagatcggtatcggcgtgctgctcacctggatcgggctgaacagcaagaacacatccatgagcttctcgtgtatcgtgatcggtatcattaccctgtacctagggaccgtggtgcaagcggacatgggctgcgtcataaactggaagggcaaggaacttaagtgcggtagcggcatcttcgtgaccaacgaggtgcacacatggacggagcaatataagttccaggcagactcccccaagcggctggccaccgccatcgccggggcgtgggagaacggcgtctgcggaatccgcagcaccacgcggatggagaacctcctgtggaagcagatcgcgaacgagctgaactacatcctctgggagaacaatatcaagctgaccgtcgtggttggcgacattatcggcgtattggaacaggggaaacgcgcccttacaccccagcccatggagctgaagtactcctggaagacctggggcaaggccaaaatcgttacggccgagatccaaaacagctccttcatcatcgacgggcccaacacccccgagtgccccagcgcgtcccgggcctggaacgtctgggaggtggaggactacggcttcggcgtattcacgaccaacatctggctgaagctgagggaggtctacacgcagacgtgcgaccaccggctgatgtccgccgccatcaaggacgagcgcgctgttcacgcggacatggggtactggattgaaagccagaagaacggctcctggaagctggagaaggccagcttcattgaggtgaagacctgcacatggcccaagacccacacgctttggtccaacggggtcctcgagagcgacatgatcatcccgaagtcacttgccggacccatttcgcagcacaatcaccggcccgggtaccacacccagacggccggcccgtggcatctcggcaaactggagctggacttcaattactgtgaggggaccacggtggtgatcacggagaactgcggcacccgcgggccctccctccggaccacgaccgtaagcggcaaactgatccacgagtggtgctgtcgctcctgcaccctgccgccactccggtacatgggagaggatggctgctggtacggcatggagattcgcccgatcaacgagaaggaggagaacatggtgaaaagcctggtgtccgccgggagcggcaaggtcgacaacttcaccatgggggtgctgtgcctcgccatcctgttcgaggaggtgatgcggggcaagttcgggaagaagcacatgatcgccggcgtattgttcactttcatgctcctgctgtccggccagatcacgtggcgggacatggcccacaccctcatcatgatagggagcaacgcctccgaccgcatgggcatgggggttacctacctggccctgatcgcgacgttcaaaattcagcccttcctcgctctgggctttttcctgcgcaagttgacgtctcgggagaacctgctgctgggcgtggggctggccatggccaccaccctgcagttacccgaagacatagagcaaatggccaacggcattgccctgggtctaatggctctcaagctgatcacgcagttcgagacctaccagctctggaccgccctcgtctccctgacctgcagcaatactatcttcaccctgaccgtggcctggcgcaccgcgacgctcattctggcgggagtgagcctgctccccgtctgccaatcctcttctatgcggaagaccgactggctaccggtggccgtcgccgccatgggggtgccacccctgcccttattcatcttcagcctgaaggacaccttaaagcgcaggtcttggccgctcaacgagggtgtgatggcggtcggcctagtgagcatcctagcctcgagcctcctgaggaacgacgtgcccatggcagggcctctagtggccggcgggctcctgatcgcctgctacgttatcaccggcacgtccgcggacctgaccgtggagaaggccgccgacgtcacctgggaggaggaggccgagcagacaggggtgtcgcacaacctcatgatcacggtcgacgatgacggcaccatgcgcataaaggacgacgagactgaaaacatcctgaccgtactgcttaagaccgccctactcatagtttccggcatcttcccctacagcatcccggcgacgctcctggtttggcacacctggcagaagcagacgcagcgttccggcgtcctgtgggacgtgcccagccctccggagacccagaaggccgaattggaggagggcgtgtaccgtatcaagcagcaggggatcttcggcaagacccaggtcggggtgggcgtgcagaaggagggcgtcttccacaccatgtggcacgtgaccagaggggccgttttaacccacaatggcaagcgcctggagccgaactgggcctccgtcaagaaggacctcatcagctacgggggcgggtggcggctgtccgcccagtggcaaaagggcgaagaggttcaggtgatcgccgtggagcccggccgcaaccccaaaaacttccagacgatgcccgggatcttccagaccaccaccggcgaaatcggggcaatcgccctggacttcaaaccgggtactagcggatcccccatcatcaatcgggagggtaaggtggtgggcctgtacgggaatggcgttgtgaccaagaacggagggtacgtcagcggcatcgcccaggccaacgccgagcccgaagggccgacccccgaactggaggaggagatgtttaagaagcgcaacttgaccattatggacctgcaccccggcagcggaaaaacgcggaagtacctccccgcaatcgtccgcgaggcaatcaagcggcgcctgcggacactgattcttgcccctaccagagtagtggcggccgagatggaggaggcattaaagggcctgcccataaggtaccagaccactgccaccaagtccgagcacaccgggcgcgaaatcgtcgtgcttatgtgccacgctaccttcacgatgcggctgctgagccccgtgcgtgtccccaactacaacctcatcatcatggatgaggcgcatttcactgacccggccagcatcgccgcccggggctacattagcacgcgggtgggaatgggggaggccgccgccatcttcatgaccgccacgccacccggcacggccgaggcgttcccccagtccaacgccccgatacaggatgaggaaagagacatacccgaacggtcatggaactccgggaacgagtggatcaccgacttcgttggcaagaccgtgtggttcgtgcccagcataaaggccgggaacgacattgccaattgcctgcgcaagaacggcaagaaggtgatccagctgtcccggaagactttcgacaccgagtaccaaaagaccaagctcaacgactgggacttcgtcgtcaccacagacatcagcgagatgggggcgaactttaaggccgaccgcgtgattgacccacggcgatgcctgaaaccggtcattctgaccgacgggcccgagcgggtgattctcgccggcccgatgcccgtgaccgccgccagcgcggcgcagcgccgtgggcgcgtaggccggaacccgcagaaagagaacgatcagtacatattcatggggcagcccctgaacaatgacgaggaccacgcccactggaccgaggccaagatgctgctcgacaacataaacacacccgaaggcattatacccgccctgttcgagccggaacgcgagaaaagcgcggccatcgacggcgaataccggctgaagggcgagtcccgcaaaaccttcgtggaactcatgcggcgcggagacttgccggtctggcttgcccacaaggtggccagcgaagggatcaaatacaccgaccggaagtggtgcttcgacggcgaacgcaataatcagatcttggaggaaaacatggacgttgaaatctggaccaaagagggcgaacggaagaagctgcgcccacgatggctggacgcgcggacctacagcgaccccctcgcgctgaaggagtttaaggacttcgccgccgggcgcaagagcatcgccctggatctcgtaaccgagatcggcagggtgccttcccacctggcgcatagaacccggaacgcgctggacaatctcgtgatgctacacaccagcgagcacgggggccgagcctaccggcatgccgtagaggagttacccgagacaatggagaccctcctgctgctcgggctgatgatcctgctcaccggcggtgccatgctgttcctgatctcggggaagggcatcgggaagacctccataggcctcatctgcgtgatcgtgtcgagtggtatgctgtggatggcagacgtcccgctgcagtggatcgcgagcgcgatcgtgctcgagttcttcatgatggtactgctgatcccggaacccgagaagcagcggacaccccaggacaatcaactcgcctacgtagtgatcggtatcctgactctggcagccatcgtggctgctaacgagatgggcctcctggagaccactaagagggacctggggatgtccaaggagcccggcgtcgtgagcccgacctcttatctcgacgtggacttacacccagccagcgcctggacgctgtacgcggtagccaccacagtgataacccccatgctccgtcacacgatcgagaactccaccgccaacgtaagcctggccgccatcgcgaatcaggccgtcgtgctcatgggactcgacaagggctggcctatctcgaagatggacctaggggttccgcttttagccctgggctgctacagccaggtcaaccccctgaccctcaccgccgccgtgctgttgctcgtgacgcattatgcgatcatcggcccagggctgcaggcaaaggccacacgggaagcccagaagcgcaccgctgcgggcataatgaagaatcccaccgtcgacggtatcatgacaatcgacctggacccagtgatctacgactccaaattcgagaagcagctgggccaggtgatgctgctggtcctctgcgccgtccaactgttactcatgcgaacctcttgggccttatgtgaggccctgaccctcgcgaccggacccattacgactctgtgggaggggtcccccggcaagttctggaacaccaccatcgccgtctccatggcgaacatcttccgcgggtcctacctggcaggcgccggactcgcctttagcatcatgaaaagcgtcggcacgggcaagcgggggaccggcagccagggggagaccttaggggagaagtggaagaaaaagctgaaccagttgtccagacgggagttcgagctgtacaaaaagagcgggatcaccgaggtggaccgcaccgaggccaaagagggcctgaaacggggcgaaactacgcaccacgccgttagccgaggatccgccaagctccagtggttcgtcgagcggaacatggtcatccccgaaggccgcgtgatcgatctgggctgtggccgcgggggctggagctactactgcgcaggcctgaagaaggtcaccgaggtgcgcgggtacaccaagggagggccgggtcacgaggagcccgtgccgatgtccacctacgggtggaacaccgtaaaactcatgagcggcaaggacgtgttctacctacccccggagaagtgcgacaccctcctatgcgacatcggggagagcagcccctcccccacggtggaggagagccggacgatccgggtcctcaagatggttgagccttggctgaagaataaccaattctgcatcaaggtcctgaacccttacatgccaaccgtcatcgagcacctcgagcgcctgcagagaaagcacgggggaatgctggtgcgcaaccccctcagtcggaacagcacccatgagatgtactggatctccaatgggaccggtaacatcgtgtcttccgtcaacatggtgagccgactgctcctcaatcggttcacgatgacccacagacggcctactatcgaaaaggacgtcgacctcggcgcagggacacgccacgtcaacgccgagcctgagacgcccaatatggatgtgatcggcgaacggataaagcgcatcaaagaggagcatagtagcacctggcactacgacgacgagaacccctacaagacctgggcctaccacggttcctacgaggtcaaagccaccggcagcgcctcctcaatgatcaacggggtggtgaagttactcacgaagccgtgggacgtcgtgcccatggtgacacagatggcgatgaccgacaccacgcccttcggccagcagcgagtcttcaaggagaaggtcgatacccgcacaccccggccgatgccgggaacccgcaaggtcatggaaatcacggccgaatggctgtggagaaccctagggcgaaacaagcgccccaggctctgcacccgcgaggagttcactaagaaggttaggacgaacgcggccatgggcgcggtattcaccgaggagaaccagtgggaaagcgctcgggcggcggtagaggacgaggagttctggaaactggtcgggcgtgagcgggaacttcacaagctcgggaagtgcgggtcatgcgtgtacaacatgatgggcaagcgggaaaagaagctgggcgagtttgggaaggccaagggaagccgagcgatctggtacatgtggcttggggcccggtacctcgagttcgaggccctgggcttcctgaacgaggaccactggttttcccgggaaaatagctactccggggtggagggcgagggtctccacaagctgggctacattctgcgggacatcagcaagatccccggcggggccatgtacgctgacgacaccgcgggctgggacacccgcatcacggaggacgacctccacaacgaagagaaaatcacgcagcagatggaccctgaacaccggcagttggccaatgcaatcttcaaacttacttaccagaacaaggtcgtgaaagtgcagagacccacccctaagggcaccgtcatggacatcatcagccggaaggatcagcgaggcagcggccaggtggggacctacggcttaaacaccttcaccaacatggaggcccagctgatccggcagatggagggggagggtgtgctgagcaaggccgacctcgagaacccccatctgctggagaagaagatcacccagtggctcgagacgaagggcgtcgaacgcctgaagcggatggcgatcagcggggacgactgtgtggtgaagccgatcgacgaccgcttcgccaacgcacttttggccctaaacgacatgggcaaggtccggaaggatatcccccagtggcagccctctaagggctggcacgactggcaacaggtgcccttctgcagccaccacttccacgagctgatcatgaaggacggccggaagctggtggtcccgtgccgcccacaggatgagctgatagggcgggcccgcatttcccagggtgcgggctggagtctgaaggagaccgcctgtcttgggaaagcctatgcccagatgtggtccctgatgtactttcaccggcgcgacctgagactcgcaagcaacgcgatctgctccgccgtgcccgttcactgggtccccacttctcgcactacgtggtccattcacgcgcaccaccagtggatgaccaccgaggacatgctgactgtgtggaacagagtgtggatcgaggacaacccgtggatggaggacaagacgcccgtcaccacctgggaagatgtgccgtacttgggcaagcgcgaagatcagtggtgcgggagcctaatcggcctgacttcgcgggccacatgggctcagaacatcctgaccgcaatccaacaggttcgctccctcattggcgacgaggagtttttggactacatgccctcgatgaagcggttccgcaaggaggaggagtctgagggcgccatatggtga

SEQ ID NO: 26182 - RNA, 9873 nt, synthetic construct
  misc_feature 1..9873: note = derived and/or modified CDS sequence (opt11) from DENV-3__KF824903__SS-prME
  source 1..9873: mol_type = other RNA
acttcgctgtgcttgatgatgatgcttcccgccaccctggcctttcatcttacaagccgggacggcgagccacgaatgatcgtgggcaagaacgagcggggcaaatccctgctgtttaagaccgcgagcgggataaatatgtgcactctcatagccatggacctgggtgagatgtgtgacgacacggtgacctacaagtgtcccctgatcgccgaggtggagcctgaggatattgattgctggtgtaacctcaccagcacctgggtgacctatgggacgtgcaaccaagccggcgagcatcggcgcgacaagcggtcggtggccctggcgccccacgtgggtatggggttggacacccggacacaaacatggatgagcgccgagggcgcatggcggcaggtggagaaggtcgaaacctgggccctccgccaccctggttttaccattctcgcgctgttcttggcccactacatcggtacctccctgacacagaaagtggtgatattcatattgctcatgctggtcacccccagcatggccatgcgatgcgtaggagtgggcaatcgtgacttcgtcgagggcttatccggggcaacctgggtcgatgtagtcctcgagcacggcgggtgtgtgaccacaatggccaagaacaagcctacgttagacatcgagctgcagaagaccgaggcgactcagctagccaccctgcggaaactgtgtatcgagggcaaaataactaacatcaccaccgactcgcgctgccccacccagggcgaggcaatcctcccggaggagcaggaccaaaactacgtctgcaaacacacgtacgtggatcgggggtggggcaacgggtgcggcctgttcggcaaaggatccctagtgacctgcgcgaagttccagtgtctggagagcattgagggcaaggttgtgcagcacgagaacttaaaatacaccgtgaccatcacggtgcataccggggatcagcaccaagttggcaacgatacccagggtgtaacagcggagatcacgccccaggcgtcaaccgtagaggccatcctgcctgaatacggtaccctcggactggagtgcagcccccgcaccggcctggatttcaacgaaatgatcctcttgaccatgaagaacaaagcctggatggtgcaccggcagtggttcttcgacctgccgttgccctggacgtccggcgcgaccaccgaaacccccacgtggaaccgcaaggagctgctggttaccttcaagaacgcccacgcgaagaagcaggaagtcgtggtgctaggtagccaggaaggggcgatgcacaccgccctgaccggggccacagagatccagaattctggagggacctcaattttcgccggccacctgaagtgccggttaaagatggacaagctggagctgaagggaatgagctacgccatgtgcctcaacacgttcgtcttaaagaaagaagtttccgagacccagcatggaacgattctaattaaggtagagtataaaggcgaggacgctccgtgcaagatcccgttcagcaccgaagacggccaggggaaggcgcacaacgggcgcctcatcacggccaaccccgtcgtgacaaagaaggaggaacctgttaacatagaggctgagccaccgttcggtgaatcaaacattgtcatcggcatcggtgacaaagccctcaagattaactggtacaagaagggctcttccatcgggaagatgtttgaagctacggcccggggcgcccgccgaatggcgatcttaggcgacaccgcatgggatttcgggagcgtgggaggggtactaaactccctcggcaagatggtccaccagattttcgggagcgcctacacggcgctgttcgggggcgtgtcctggatcatgaaaatcgggatcggcgtgctgctcacttggatcgggttaaacagcaagaacacgtccatgtcgttttcctgtatcgtaatcggaattatcacactctacctgggtaccgtggtccaggcggacatgggctgcgtaatcaactggaagggcaaggagttgaagtgcggttctggcatctttgtgaccaacgaagtacacacgtggaccgagcagtataagttccaggctgactcccccaagagattagcaaccgccattgccggcgcctgggagaacggcgtttgcgggatacgcagcactacgcggatggaaaacctcctgtggaagcaaatcgctaatgagctgaactacatcctctgggaaaataacatcaagttaacggtggtggtgggagacataatcggcgttctagaacaggggaaacgcgccttaacgcctcagcccatggaattaaagtattcatggaagacctggggcaaggctaagatcgtgacggcagaaatccagaactcatcgtttatcattgatggtcccaatacccccgaatgtccgagcgcgtcccgggcctggaacgtctgggaggttgaggactatggcttcggagtgttcaccacgaacatttggctaaaactccgcgaggtctacacgcagacctgcgaccacaggctgatgtccgcagcaatcaaggacgagcgcgctgtccatgcggacatgggctactggatcgagagccagaagaacggcagctggaagctggagaaggccagcttcattgaggtaaagacctgcacgtggcccaagtcgcacactctctggtcaaacggggtccttgagagtgacatgatcatccccaagagcctggccggtcccatttcccagcacaaccacagacccgggtaccacacgcaaaccgccggcccatggcaccttggaaagctagagctagatttcaactactgcgaggggaccaccgtcgtgatcaccgagaactgtggtacacgcgggccaagcttgcggaccacgacggtctctggcaagttaattcatgagtggtgctgcaggtcttgtacgttaccgccccttcggtacatgggggaagacggctgctggtacggtatggagatccggccgattaatgagaaggaagagaacatggtcaagtcgctggtctcagccgggtccgggaaggtggacaacttcaccatgggcgtgctatgccttgcgatactgttcgaggaggtaatgcggggcaaattcggcaaaaagcacatgatcgccggcgtcctgttcaccttcatgctcctgctgagcgggcagatcacgtggcgagacatggcccacaccctcatcatgatcgggtctaacgccagtgaccggatggggatgggggtcacctacctggcactaatcgctaccttcaaaatccaacccttcctagcgctgggcttcttccttaggaaactcacgtcccgggagaacctgcttctcggcgtggggctggcgatggccactaccttgcaactacccgaggacatcgaacaaatggccaacggcatcgccctggggctgatggccttgaagctgatcacccagttcgagacgtaccaactatggaccgccctcgttagtctgacatgcagcaacaccatcttcactctaaccgtcgcctggcgcaccgcaaccctcatactggccggcgtcagtctgttgcccgtctgccagagctccagcatgcggaagacggactggctgccggtggctgtcgcagctatgggggtgccgccgctccccctattcatctttagtctgaaggacaccctgaagaggcgcagttggcctctcaacgagggcgtgatggcggtcggcctggtgagtatccttgcgagctcactcctgaggaatgacgtgcctatggccgggcccctggtcgctggcgggctcctgatcgcctgctacgtgataactggcaccagcgcggatctcactgtggagaaggccgccgacgtcacctgggaggaggaggccgaacagacgggggtttcccacaacctcatgatcaccgtagacgacgacggtacgatgcgaataaaagacgatgagaccgagaatatcctgacggtcctgttaaagaccgcccttcttatcgtgagcggaatcttcccctactccatccccgcgaccttactagtctggcacacgtggcagaagcagacgcagcgcagcggggtcttgtgggacgtgcccagcccgccagagacccagaaggccgagctggaagagggggtgtaccgcatcaaacagcaggggatcttcggcaaaacccaggttggggtgggcgttcaaaaggagggcgtctttcacacgatgtggcacgtcaccaggggggccgtgctgacccacaatggcaagcgccttgagccaaactgggccagcgttaagaaggacctcatatcctacggaggtgggtggcggctgtcggcgcagtggcagaagggcgaggaggtgcaagtgattgccgttgaacccggccgcaaccccaagaacttccagacgatgcccggaatctttcaaacgaccaccggcgagataggagccatcgctttagactttaagcctggcacctctggcagccccataatcaaccgggaggggaaggtggtgggtctttatgggaacggagtcgtgacgaagaacggagggtatgtgagtggcatcgcccaggcgaacgccgagccggagggtccaacgcccgagctagaagaggagatgttcaagaagcgcaatctgaccatcatggacttacaccctgggtccggaaaaacccggaagtatctccctgcaatcgtccgcgaggcgattaagcggcggcttagaacgctaatcctcgccccgacacgcgtggtggcggccgagatggaggaagcactaaaagggttacccatccggtaccagaccaccgccaccaagtccgagcataccgggcgcgagatcgtcgagtgcatgtgtcacgctaccttcaccatgcggctcctgtctcccgtacgcgtcccgaattacaatctcatcatcatggacgaggcgcacttcacggaccctgcgtcaatcgccgcacggggatacatttccacccgcgtgggcatgggggaggcggccgccatcttcatgacagccactccgcccgggacggcggaggcgttcccccagtcgaacgccccgatccaagatgaagagcgcgacatccccgagcggtcctggaatagcggaaacgagtggataacagactttgttggcaaaactgtgtggttcgtcccctccataaaggccgggaacgacatcgccaactgtctccgcaaaaacggcaaaaaggtgatccagctgtcgcggaagaccttcgacacggagtatcaaaagaccaagttgaacgactgggatttcgtggtcaccaccgacatctccgagatgggcgccaacttcaaggccgaccgcgtaatcgatccccgacgctgccttaagccggtgatactgacggacgggcccgagcgggtcatcctggcgggcccaatgcccgtaacagccgcgagcgcagcgcagcggcgggggcgagtcggcagaaacccacagaaggagaacgaccagtacatcttcacagggcagcctctgaataacgacgaagaccacgcccactggaccgaggccaaaatgctgctggataacatcaacacgccagagggcatcatccccgccctcttcgagccggagcgagagaaaagcgcggcgatagacggcgagtaccggctaaaaggggagagccgcaagaccttcgtcgaacttatgcggcggggcgatctccccgtgtggttagcccacaaggtggcctctgaggggatcaagtacaccgaccggaagtggtgtttcgatggcgagaggaacaaccagatattagaggagaacatggacgtcgagatctggacgaaagagggcgaaaggaagaaacttcgcccccgctggctggacgcgcggacctacagcgaccccctggcactgaaagagtttaaggacttcgctgccgggcgcaaatccatagccctggacctcgtaacggaaattggccgcgtcccgagccacctcgcccaccggacacggaacgcgctggacaacctggtgatgctccacacctccgagcacgggggccgcgcgtatcggcatgccgtggaagaactaccagaaacaatggagacgttgctcctactcgggttaatgatccttctaacaggcggagccatgctattcctgataagcggaaagggaatcggcaagaccagcataggcctgatatgcgtcatagtgtcctctgggatgctctggatggccgatgtgccgcttcagtggatcgcgtccgcgatcgtcctggagttcttcatgatggtgctcttaataccggagcccgaaaagcagcgcactccccaggacaatcagttggcctacgtggtaattggcatcctcacgctggccgccatcgttgcggccaacgagatgggcttgctcgagaccaccaagcgggacctggggatgtctaaggagcccggcgtggtctccccgaccagctacctggacgtggacttgcaccccgcctccgcgtggacgctgtacgcggtggccaccactgtcattacccccatgctgcgacacacgatcgagaacagcactgccaatgtgtccctcgccgccatcgctaaccaggccgtggtcttgatgggcctggacaaaggctggcccatcagcaagatggacctcggggtgccactgttggccctcggctgctacagtcaggtgaaccccctgacactgaccgcggccgtactcctgctcgtgacacactacgcgattatcggccccggcctccaggccaaagctacacgggaggctcaaaagcgcaccgctgccggaataatgaagaaccccaccgtggatggtatcatgacgatcgatctggatccggtcatatacgactcaaaattcgagaagcagttaggccaagtaatgcttctggtgctgtgcgccgtccaactcctgctgatgaggaccagttgggcgctctgcgaggccctgaccctggcgaccggccccatcacgacactctgggagggaagccccggcaagttctggaacaccaccatcgctgtatctatggccaatatcttccgcgggtcgtatttagccggcgccgggctggcgttctccatcatgaagtcagtaggcacaggaaagcgggggacaggctcccagggggagacccttggtgagaagtggaagaagaagctcaaccagctaagccgcagagaattcgagctatacaagaagagcggtatcactgaggtcgaccgcacggaggccaaggagggcctcaagcggggagaaaccacccatcatgccgtgtcccgcgggagtgcgaagcttcaatggttcgtggagcggaacatggtgatacctgagggacgcgtgatcgatctcgggtgtggcagggggggttggtcctactactgcgcgggactgaagaaggtgaccgaagtccgtggctacactaaaggcggcccgggccacgaggagcctgtccccatgagcacgtacgggtggaacaccgttaagctaatgtccggcaaggacgtcttttacctgccgccagagaagtgtgataccctgctctgcgacatcggggagagctctcccagcccgaccgtggaggagtcccgcaccatcagagtgctgaagatggtagaaccctggctaaagaacaaccagttctgcatcaaggtgctgaacccatatatgcccaccgtgatcgaacatcttgaacggctccagcgcaagcatgggggcatgcttgttcgcaaccccctttcccggaactccacccacgagatgtactggattagcaacggaaccggcaacatcgtgtccagcgttaacatggtatcccgattgctgttaaaccggttcacgatgacccaccgccggcccaccatcgagaaagacgtcgacctcggcgcggggacccgccacgtgaatgcagagccagaaacccccaacatggacgtcataggtgagcggattaagcgtataaaggaggagcatagctccacctggcattacgatgacgaaaatccctacaagacctgggcgtaccacgggtcgtacgaggtgaaggccaccggatccgcctcgagcatgataaacggtgtagtaaagcttttaacgaagccgtgggacgtggtcccgatggtgacccagatggcgatgaccgacaccacaccctttggccagcaacgggttttcaaggagaaggtcgacacccgcacgcccagacccatgcctggcaccagaaaagtgatggagatcacagccgaatggctctggcggaccctcgggcggaataaacgccccagactgtgcacgcgggaggaattcactaagaaggtgcggacgaacgccgccatgggcgctgtcttcaccgaggaaaaccagtgggagtctgcccgtgcagccgtggaggacgaggagttctggaagctcgtcggacgggagcgggagttgcacaagctcggcaaatgcggcagctgtgtatacaatatgatgggcaagcgggagaagaagcttggtgaattcggaaaggcgaagggctcccgggcgatctggtacatgtggctgggagcccggtatttggagttcgaagccctcgggttcctgaacgaggatcactggtttagccgcgaaaattcctactcgggggttgaaggcgagggtctgcataagctcgggtacattctgcgagatatatctaagatccccggaggggccatgtacgccgacgacaccgcgggctgggatacccgcattacggaggacgacctgcacaatgaggaaaagatcacgcagcagatggacccagagcacagacagctggccaacgctattttcaaactcacctaccagaacaaggtggtcaaggtgcagaggcccacccccaaaggcacggtcatggacatcatcagccggaaggaccagcgcggttccggccaggtcgggacgtacggtctcaacaccttcaccaacatggaggcacagctcatccggcagatggagggggagggcgtgctgagcaaggccgacctggagaatccccacctcctggagaaaaagattacccaatggctggagactaaaggagtcgagcgcctcaaacggatggccatctcgggtgacgactgcgtcgtaaagccgatcgatgaccgcttcgccaacgcgctgctggctctgaatgacatgggcaaggtgcggaaggatatccctcagtggcagccgagcaagggatggcacgactggcagcaggtccccttctgttcacaccacttccatgaactgattatgaaggacggccgcaagctggtagtgccatgtcgacctcaagacgagctcatcggccgggcgcgcatcagccagggggcgggctggtccctgaaggagaccgcctgcctgggaaaggcctacgcccagatgtggagcctaatgtacttccaccggcgcgacctgcggctggcgtccaacgctatctgcagcgcagtccccgtgcactgggtgccaacctcacggaccacttggagcatccacgctcaccaccagtggatgactaccgaggatatgctcaccgtgtggaaccgtgtctggatcgaggacaacccgtggatggaggacaagacgcccgtcaccacatgggaggacgtcccatacttaggcaagcgcgaagaccagtggtgcgggagcctaatcggcctaacttcccgcgccacctgggcgcagaatatcctgaccgccatccagcaggtgagaagcctgatcggagacgaagagttcctcgactacatgccgtccatgaaacggttcagaaaagaagaggagtcagagggcgcaatatggtaa

SEQ ID NO: 26183 - RNA, 9873 nt, synthetic construct
  misc_feature 1..9873: note = derived and/or modified CDS sequence (opt11) from DENV-3__JF504679__SS-prME
  source 1..9873: mol_type = other RNA
actagcctatgcctaatgatgattctaccagcagcactagccttccacctcacaagccgagacggcgaacctcgcatgatcgtgggtaagaacgaacgaggaaagtcgctcttgttcaaaacagcgagcggcataaatatgtgcacgctaatcgcaatggatcttggcgaaatgtgcgacgatacagtcacctacaaatgcccgcacatcaccgaagtagaacccgaagacatcgactgttggtgcaacctaaccagtacctgggtaacctacggcacatgtaaccaagccggggaacataggagagacaaaagatcagtagccctagcgccccacgtaggcatgggcctcgacacccgcacccaaacctggatgtcggccgaaggggcatggcgtcaggtggaaaaagtagaaacttgggccctaagacacccgggcttcaccatattggcactgtttttggcccactacatcggaacaagtttaacgcaaaaagtagtcatctttatcctcctcatgctcgttaccccatcgatgactatgaggtgcgtgggggtgggaaatcgtgacttcgtagaaggattatctggagcgacgtgggtggacgtagtgctagaacacgggggctgcgtaaccacaatggccaagaataaaccgactctcgatatagaactccaaaagactgaagccacacagctagccaccttgcgaaagttgtgtatagaaggcaagataaccaatataaccaccgactcccgatgccccacgcagggggaagcagtcctaccagaagaacaggatcagaattacgtatgcaagcacacatacgtcgacaggggctggggtaacggctgcggcttattcggcaaaggatcacttgtaacctgtgccaagttccaatgcctagagcccatcgaaggcaaggtagtacaatatgagaacctcaaatacacagtgatcatcacggtccacaccggtgaccagcaccaagtcggtaatgaaacacagggagttacagcagaaataacgccgcaggcctcaacgacagaagcaatcctccccgagtacgggacattagggctggagtgtagcccccgcaccggattagactttaatgaaatgatcttgctgacgatgaaaaacaaggcgtggatggttcaccgacagtggttctttgatctaccactaccttggacttccggcgctacgaccgagactccgacttggaacaggaaagaacttctcgtcactttcaaaaacgcgcacgccaagaagcaagaagtggtggtgctcgggtcacaagaaggagccatgcacacggcactgaccggcgcaaccgaaatccagaatagcggcgggacgtctatctttgcaggccatcttaaatgccggctcaaaatggataaattggaactaaaaggcatgtcctacgcaatgtgcaccaacacctttgtattaaagaaggaagtctcagagacacaacacggcaccatcctcattaaggtggagtacaagggagaagacgcaccctgcaaaatccccttctctactgaagatggccaaggcaaagcccacaacggacgccttattacggctaatcccgtagtaacaaagaaagaagaaccagtaaatatagaagctgaaccgccctttggagaatcaaacatagtgataggcataggtgacaacgcactaaaaatcaactggtataagaaaggatcaagcatcgggaaaatgtttgaagcaacggcccgtggagcccgaagaatggcaattctaggcgacacagcgtgggactttggaagtgttgggggagtgcttaatagtttaggaaaaatggtacatcaaattttcggctcggcgtacacagctctgtttagtggagtatcatgggtgatgaaaataggaattggcgtcctgctgacctggatcgggctcaacagcaaaaacaccagtatgtcattcagctgtatagcgattggcattatcacactctatctaggcgccgtcgtgcaagctgacatgggatgcgtcatcaactggaagggcaaagagctgaaatgcggcagcggcatttttgtcaccaacgaagtccacacgtggacagaacagtacaaatttcaagcggatagcccgaaacgcctggccaccgtaattgcgggggcctgggaaaacggggtctgtggcataaggtcaactacgagaatggaaaacctcctatggaaacaaattgccaacgaactgaactacatcctgtgggagaacaacatcaaactcacggttgttgtcggtgatacaattggtgtactcgaacagggaaagcgtaccctaacgccgcagcccatggaactgaaatattcttggaagacatggggcaaagccaagatcgtcacagccgaaacgcaaaatagttccttcatcatagacggaccaaataccccagaatgcccatcagctagccgagcctggaacgtatgggaggtcgaagactacggcttcggcgtgtttacgacaaacatatggctaaagctacgagaagtctacacccaaatgtgcgaccataggttaatgagtgccgccgtcaaagacgaacgagctgtccatgcagacatgggttactggatcgagtcccagaaaaacggcagttggaaactagagaaagcgagcctgatagaggtaaaaacgtgtacatggcccaagtcacacacgctatggtccaacggcgtgctggaatccgacatgataatcccgaaaagcctagcgggtcccgtcagtcaacataactacagacctggctatcacacacagaccgcagggccatggcacctcggcaaattagagttagacttcaactactgcgagggcactaccgttgtaattacagaaaactgcggaaccagaggcccgtcactccgaaccaccacggtaagcggaaaactaatccacgagtggtgctgccgcagctgcacgctgcccccactacggtacatgggagaggacggatgctggtacgggatggagatacgcccgatcagcgagagagaagaaaacatggtaaaatctctagtgagcgcgggcagcggaaaagtcgacaacttcacaatgggagtactctgccttgccatcctgtttgaggaagtcatgcgaggcaaatttggaaagaaacacatgattgcaggcgtcttcttcactttcatgttgctgttaagcggacagataacctggcgcgacatggcccataccttgatcatgataggatctaacgcgagcgatcgcatgggtatgggggtaacttaccttgccctgatcgcaacattcaaaatccaaccattcctagcactaggcttctttctcaggaagctaacgagccgagagaatctactcctgggcgtaggactcgcaatggctacaacgatacagctacccgaagatatcgaacaaatggcaaacggaatagccctgggattaatggccctgaaactgataactcaattcgaaacttaccagctatggacagcactaataagcctcacctgttcaaacacgatattcaccttaactgtagcatggagaacagccacattgatccttgctggcgtctcacttttaccagtgtgccaaagctcgtcgatgagaaagaccgactggctacccatgaccgtcgccgcgatgggagtgccacccctccccctgttcatattcagcctcaaagacacgctaaagcgccgaagctggcccctaaatgagggcgtgatggctgtagggctcgtgtccatattggcatcttcgttactaagaaatgacgttcccatggccggcccgttggttgccggcggcttactcatagcttgctacgttatcacagggacgagcgcagacctcaccgtagaaaaggcggcggacgtaacttgggaggaggaagctgaacagacgggggtttcgcacaatcttatgatcacagtagacgacgatggaaccatgcggataaaggatgacgagacggaaaacatcttgacagtgctactaaagaccgcactattgatagtgtctggaatcttcccttactcaattccagcgaccctcctagtctggcatacctggcagaagcagacgcaaaggagcggagtcctatgggatgtcccatctcctccagagacacagaaagcagaactggaagagggagtgtacaggatcaaacagcagggtatcctaggcaagactcaagtcggcgtaggcgtccagaaggaaggtgtcttccatacgatgtggcacgtgaccagaggagcagtgctcacccacaatggaaagcgactggagccaaactgggcttctgtgaagaaggatctgataagttatggagggggctggcgcttgagcgctcagtggcagaaaggagaggaagtccaggtcatcgccgtagaaccagggaagaaccctaagaactttcaaacaatgcctgggacgttccagacgaccacaggcgaaataggtgccatcgcgctagacttcaaacccggcacttcgggatcgcccatcatcaatcgagaagggaaagtagtgggcctgtacggcaacggagtagtcaccaaaaacggaggctatgtctccgggatcgcccaaacaaacgcagaaccggacggaccgacacctgagcttgaagaagaaatgttcaagaaacgaaaccttacaattatggacctgcacccgggaagtggcaaaacacgaaaatatctaccggccatagtacgtgaagcgataaaacgtcgtttgaggacccttattctggcccccaccagagtagtcgcggccgagatggaggaagctctgaagggcctgccaataagataccagacgaccgcaacaaagtcagaacacaccggtcgtgagatcgtcgacttgatgtgtcacgcaaccttcacaatgcgactcttatcgccggtccgagtacccaattacaacttaatcatcatggacgaggcgcattttacggatccggccagcatcgcagcgcgcggttacatcagtacacgcgtcgggatgggagaagcggccgcaatttttatgacggccacaccgcccggaaccgctgatgcattcccgcaaagcaacgccccgattcaggacgaggaacgagacatacccgaaaggagctggaacagtggaaacgaatggataacggactttgccggtaagaccgtgtggttcgtcccgagcatcaaagcgggtaacgacatagccaactgcctcagaaagaatgggaagaaggtcatacagctaagccgcaaaaccttcgataccgaataccagaaaacgaaactgaacgactgggacttcgtagtaacgaccgacatatccgagatgggagcgaacttcaaggccgacagggtgatagatccccgacgatgcctgaaacctgtgattctcacggatggccccgaaagggtaatcctcgcaggcccgatgccagtcaccgtcgccagtgccgcccaaaggcgcggtcgcgtaggcagaaatcctcaaaaagaaaatgatcaatacatatttaccgggcagccactcaacaacgacgaggatcacgcgcactggacggaagcgaaaatgttattagataacatcaacacaccagaaggtatcatcccagcactctttgagcccgaaagagagaagtcagccgcgatcgacggagaatatagacttaagggcgaatcacgaaagacattcgtcgagctaatgcgccgcggagacctgcctgtgtggcttgcccacaaggtggcaagcgaaggaataaaatacactgacaggaaatggtgcttcgatgggcaacggaacaaccaaatccttgaagaaaatatggacgtagaaatctggaccaaagaaggagagaaaaagaaactgcgtcctagatggctcgatgcacgcacatattcagacccactagccctaaaggaatttaaagactttgcagcgggacgaaaatcgatcgcgctagacttagtgaccgagatcgggcgcgtcccgagtcacttggcacacagaaccagaaacgcactggacaacctagtgatgttacacacatcagaacacggaggcagagcctaccgccacgcggtagaggaattgcccgagacgatggagaccttactcttattaggactgatgattctactcaccggaggggcaatgctattcctaatctcaggaaaaggtataggcaaaacatccatcgggctgatatgcgttatagctagcagcggcatgctttggatggcggagataccgcttcagtggatcgcatccgcaattgtgttggagttcttcatgatggtcctattgatacccgaaccagaaaaacaacgtaccccacaagacaatcaattggcgtacgtagtgattggaatcctcaccctcgcagcgataatagccgccaacgagatgggcctcttggaaactacaaagcgggaccttggcatgagcaaagagccgggcgtggtctccccgacctcctacctggatgtggacctccacccagcatccgcctggacactgtacgcggtagctaccacagtaatcacgcctatgcttagacatacgatagaaaacagcacagcgaacgtcagtctggcagccatagctaaccaggcagtcgtgctgatgggactagacaagggctggcccatctcaaaaatggacctaggcgtgcctctactcgcactaggctgctactcccaagtaaacccactaacactcacggcagccgtgctcctactcgttacgcactacgcaattataggccctgggttacaagcgaaggccacccgtgaagcccagaaacgtacagcagcgggtatcatgaagaacccaacggtagatgggataataacaatagacttggatcccgtgatctacgactccaaatttgagaaacagctcggacaggtcatgctcctggtactatgcgcagtccaactactgttaatgcggaccagctgggcactgtgcgaagccttgacattagcaaccggcccgatcaccaccctctgggaaggatccccggggaaattctggaacaccacaatagccgtaagcatggcgaacatcttccgaggcagctacttagctggcgcaggcttagcgttctcaataatgaaaagcgtagggacaggcaagagaggtacaggaagtcaaggagaaaccttaggtgaaaagtggaaaaagaaactaaatcaactcagtagaaaagagttcgacctgtataagaaaagcgggatcaccgaagttgaccgcaccgaagccaaggaaggcctaaaacgaggagagacgacccaccacgctgtgagcagaggcagtgccaaattgcaatggttcgttgaacgcaacatggtgatcccagaaggacgcgtcatagacctcggatgcggtcgaggagggtggtcttactactgcgctggactcaagaaagtaacggaggtaagaggctacaccaaaggcggacctgggcacgaagaacccgtaccaatgagcacttacggatggaacatcgtaaaactaatgtcgggtaaagacgtgttctatctacctccggagaagtgtgacacactgctatgtgacataggtgaatcttctccgtcgcccacggtcgaggagtccaggaccatccgggtcctaaagatggtagaaccttggttgaagaacaaccaattctgcataaaagtattgaacccatacatgccagcggtgatcgagcacctcgaacggctccaaaggaagcatggtggaatgttggttaggaacccactttcccgtaactcaacccacgaaatgtactggatcagcaacggaacagggaacatagtctccagtgtgaacatggtaagcagactcctactcaaccgatttacaatgacccaccgacgccccaccatagagaaagacgttgacttaggagcgggaacgaggcacgttaacgcagaaccggagacccccaacatggacgtcataggcgaaagaattagaagaattaaagaagaacacaattcgacatggcattacgacgacgaaaatccatataagacatgggcgtatcacggttcttacgaggtgaaggccacaggctccgcctcaagtatgataaacggggtagtcaaactgctcacgaagccgtgggacgtagtaccgatggttacgcaaatggcaatgactgatacgaccccattcggccagcaacgagtattcaaagaaaaagtcgacacccgcacgccgcgaccaatgccaggcaccagaaaagtcatggagataaccgcagaatggctctggcgcaccctcggcagaaacaaaagacctagactctgcacaagagaggaatttaccaaaaaggtcagaacaaacgcggcaatgggggcagtattcacggaggaaaaccaatgggactccgcaaaggcagccgtggaagatgaagagttctggaaactcgtagaccgggagcgggagctacacaaacttggaaaatgcggaagctgcgtttacaacatgatgggaaaacgcgagaagaaactaggggaatttggaaaagcaaaaggttcgcgagcaatatggtatatgtggctcggggcccgctatctggagttcgaagcactaggctttctaaacgaagaccattggttctcgcgggaaaacagttacagtggggttgaaggcgaaggactccacaaacttggctacatcctccgagacatcagcaagattccaggcggggccatgtatgcagatgacacagccggatgggacacccgaataacagaagatgacctacacaacgaagaaaagatcacacagcaaatgaaccctgagcaccgtctcctggccaacgctatcttcaaactcacgtaccagaacaaggtcgttaaagtgcaacgaccaaccccgacaggaacggtcatggacattatatcacgaaaggaccagcgcggatctggacaggtaggcacatacgggctgaacactttcaccaacatggaggcgcagctagtgcgccaaatggaaggcgaaggagtccttagcaaggcagacttagaaaacccacacctccccgaaaagaaaatcacccaatggctggagacaaagggcgtagagcgactcaaacggatggcaatatccggagacgactgtgtcgtaaaacccatagacgaccgattcgcaaacgcgctcttggcattgaatgacatggggaaagttaggaaggacataccacaatggcaacccagcaaaggttggcacgactggcaacaagtccccttctgctcacatcacttccatgagctgataatgaaggatggacgcaagctcgtcgtcccgtgccgcccccaagatgaactaataggtagagctagaatctcacagggagccggatggagcttacgcgaaacggcctgccttgggaaggcctacgcacaaatgtggagtctaatgtacttccacagacgagatctaagactggcaagcaacgcgatctgtagcgcagtacccgtacactgggtccctacatcccgaacaacttggagcatccacgcacaccaccaatggatgaccactgaagacatgttgacagtctggaatagggtctggatcgaggacaacccgtggatggaagataaaacgcccgtaactacatgggagaatgtcccatacctaggcaagcgagaagaccagtggtgcgggagcttgataggcctcacgtcacgagcgacttgggcgcagaacatcccgacagccatacaacaagtgcggtctctgatcgggaacgaagagttcttagactacatgccgtcgatgaaacggtttaggaaggaagaggaaagtgagggcgcaatttggtaa

SEQ ID NO: 26184 - RNA, 9873 nt, synthetic construct
  misc_feature 1..9873: note = derived and/or modified CDS sequence (opt11) from DENV-3__KC425219__SS-prME
  source 1..9873: mol_type = other RNA
acatccttatgccttatgatgattctacccgcggcccttgcgttccatctcacgagtcgcgatggggaacccagaatgattgttggcaaaaatgaaagggggaaaagccttctttttaaaacagcaagcggaatcaacatgtgtacactaatagcaatggacctaggagaaatgtgcgacgacacagtaacatataaatgcccacacataacagaagtagaaccagaagatatcgattgctggtgcaacctaacgtcgacatgggtaacatatgggacttgtaaccaagcaggagaaagacgcagggacaagcgctccgtcgccttagcaccccacgtcggaatgggactcgacaccagaacacaaacatggatgagtgcagaaggggcatggcgtcaagtggaaaaagtagaaacatgggctcttaggcatcccggattcacaatactggccttattcctagcacattacatcgggacttccctgacgcaaaaagtcgtgatctttatcctcctcatgttagtgacgccaagtatgaccatgcggtgcgtcggggtcgggaatcgggatttcgtcgaggggcttagcggagctacatgggtcgacgtagtgctcgaacacgggggctgcgtaaccacaatggccaaaaacaaacccaccctagacatagagttgcagaaaactgaggccacgcaactagcgaccctccgaaaattatgtatagaaggcaaaataacgaacataaccacggactcgaggtgcccaacacaaggggaggccgtactcccggaagaacaagaccaaaattatgtatgcaaacacacctacgtagatcgcggctggggcaacggatgcggactgttcggtaaagggagccttgtcacatgcgccaagtttcaatgcctagaacccatagaaggaaaagtcgtgcaatacgaaaacctaaaatacacagtaatcataacggtgcacaccggcgaccagcatcaagtgggcaacgagacgcaaggcgtaacagcagaaataaccccacaagcaagcacgaccgaagcaatactaccggagtacggaacgctgggcctggagtgctcgcctcggacggggctggacttcaacgagatgattcttctcaccatgaaaaataaagcatggatggtgcacaggcaatggttcttcgacttgcccctaccatggacgtcaggagcgacaacggaaacgccaacatggaaccgcaaagagctcctagtcaccttcaaaaacgcgcacgccaagaaacaggaggttgtcgtattaggaagccaagagggggcaatgcacacggccttaactggagcgacggagatccaaaattccgggggaacaagcatcttcgcgggacacctaaaatgtagattaaaaatggacaagctagagctcaaaggtatgagctatgcgatgtgcacgaacacatttgtacttaagaaagaagtaagcgaaacccagcacggaacaatcctgatcaaagtggagtaccgtggcgaagatgccccgtgcaaaatccccttcagtaccgaagatggacagggcaaggcccacaacggaagactcataacagccaacccggtggtaacgaagaaggaagaacccgttaatattgaagccgaacccccttttggcgaaagtaacatcgtaataggaatcggcgacaacgcgttaaagataaactggtacaagaaaggaagttcaatcggaaagatgttcgaagcaactgcaagaggcgctcgaagaatggctatcctgggagacactgcatgggacttcggcagcgtgggaggcgtcctgaactccctcggaaagatggtccatcagattttcggatcagcatacaccgccctcttcagcggcgtgtcctgggtcatgaaaataggcataggcgtcctcctgacatggattggtttgaatccaaagaacacttccatgagcttctcttgcatagcgatcgggataataactttgtatttaggcgctgtggtccaggcagatatggggtgcgtcatcaattggaaaggaaaggaactaaaatgtgggagcggcatcttcgttacaaacgaggtccacacatggacggaacagtataaatttcaagccgatagtcccaagcgactggcgactgccatcgcaggcgcgtgggaaaacggcgtctgcgggataaggtcaaccaccagaatggaaaacttattatggaagcaaatcgcgaacgagctgaattacatattatgggaaaacaatataaaacttaccgtagtcgtcggagacataatcggagtcctcgaacaggggaagcggaccttgacaccccaacccatggagctgaagtacagctggaagacatggggcaaggcaaaaatagtaaccgcagagacacagaactcgagcttcataatagatggcccaaatacgcccgaatgccctagcgcctcgagggcatggaacgtatgggaggtagaagactatggttttggcgtcttcaccacaaacatctggctgaaactcagagaagtgtacacccaactgtgcgatcatcgactaatgagcgcagcggtgaaggatgagcgcgcggtgcatgcagacatggggtactggatagaatcacagaaaaacggctcatggaagctagagaaggcaagcctcatagaagtaaaaacctgtacatggccgaaaagccacaccctatggagcaacggcgtcctcgagagcgacatgataatacccaaatcactggcgggtccaatatcccaacataaccaccggccgggctaccacacacagaccgcaggcccgtggcatctaggaaaattggagcttgatttcaactactgcgaaggaaccacagtggtcattactgagaattgcgggacccgcgggccatctctcaggaccaccaccgtaagcggcaaactgatccatgagtggtgctgtcgcagctgcacattaccaccgctcaggtacatgggtgaggacgggtgttggtacgggatggagatcaggcctataagcgagaaggaggaaaacatggtcaagagtctagtaagcgccggaagcggcaaagtagacaatttcacgatgggagtgctatgcctggcgattctattcgaagaggtgatgcgtggcaaattcgggaagaaacacatgatcgcgggcgtgttcttcacgttcgtactgctcttatctggccagatcacttggagagacatggcgcacacattaatcatgattggatcaaatgccagtgatcgaatgggcatgggcgtgacatacctcgctctgatcgccacatttaagattcagccttttctcgcgctagggttctttctaagaaagttgacatcacgggaaaatctactcctaggcgtggggctagcgatggcaactaccctacaactcccggaagatatcgaacagatggccaatggcatagccctgggtctaatggccctaaaactgatcacccaattcgagacatatcagctttggacggcactgatatcgcttacgtgctcgaacacgatgttcacactcactgtagcatggcggacggcgacccttatcttagccggggtctccctcctcccagtgtgccaaagcagttcaatgcgcaagacggactggctgcccatggcggtcgcggcaatgggcgtgccacccttgcccctcttcatttttagccttaaggacacactgaaacgcaggagctggcctctaaacgaaggagtaatggcggtgggactcgtcagtatactagcaagttcactcctcaggaatgacgtacctatggcaggacccctggtagcgggagggctactgatcgcctgttacgtgatcacagggacaagcgcggacctgacggtcgaaaaagcagcagacataacttgggaggaggaggcagaacaaaccggggtaagccacaatttgatgataactgttgatgacgacggcaccatgagaattaaagacgacgaaaccgaaaacatactcacagtactcctaaagaccgcacttctcatagtgtcgggagtatttccctattcaatcccagcaacactgctcgtctggcatacatggcagaagcaaacgcaaaggagtggggttttatgggatgtacccagcccgccagaaacgcaaaaggccgagttagaagaaggcgtatataggatcaagcaacaaggaatcttcggcaagacccaggtcggggtcggtgttcaaaaagaaggagtctttcatacaatgtggcatgtgactagaggggccgtcctcacatataacggtaaacgactagaacccaactgggcgtcagtaaagaaagacctgatcagctacggagggggatggcgcttatcggcgcaatggcaaaaaggcgaagaggtccaggtcatagcagtggaaccgggtaaaaatcccaaaaatttccaaaccatgccgggaacctttcaaacaactaccggggagatcggcgccatcgcgctagacttcaaaccagggacatcggggagccccataatcaaccgggagggcaaggtagtcgggctgtacggcaacggggtggtgaccaaaaacggcggctacgtcagcgggattgcacaaactaatgccgagcccgatggacccacccccgaactcgaagaagaaatgttcaaaaagcgaaaccttacaataatggacttacacccaggtagcggaaaaacaaggaaatacttacccgcaatagtgagagaagccatcaagaggaggctcaggacgctgatactcgcaccaacgagagttgtcgccgcggaaatggaagaggccttaaaagggctaccgatccgctaccaaacaacggcaacgaaaagcgagcacaccgggagggaaattgttgatctgatgtgtcatgcaacgttcaccatgcgccttctatcaccggtccgagtgcccaactataacctaatcataatggacgaagcccacttcacggacccagcaagcatcgccgcccgcggctacatatccacgcgcgtaggcatgggagaagcagccgcgatattcatgacggcgactccacccggaacagcagatgcatttcctcaatccaatgcccccatacaagacgaagaaagagacataccagaacgctcgtggaacagcgggaatgaatggattacggactttgctggaaagacagtttggttcgtgccgagcataaaagcgggaaatgacatcgctaactgcctcaggaaaaacggcaagaaagtcatccagctgtcccgcaaaacattcgatacagaataccagaaaaccaaactcaatgattgggacttcgtggtcacaaccgacatctccgaaatgggggcaaatttcaaagcagacagagtcatcgaccccagacgatgcctcaagcccgtaatactcacggacggcccggaacgggtcatcctcgcgggtccaatgcctgtaaccgctgcgtccgctgcgcagcgccgcggacgagtcggccgaaacccgcagaaggaaaatgaccaatatatcttcacaggccagcccttaaacaacgacgaggatcacgcccactggacggaagcaaagatgctactagataacatcaacacccctgaagggataattccggcactcttcgagccagaacgtgagaagagtgctgccatcgacggagaatacaggctcaagggagagtcaagaaaaacgttcgtagaactcatgcgccgtggggatctgccagtgtggctcgctcacaaagtcgcatcggagggcatcaaatacaccgataggaaatggtgttttgatgggcaacgaaacaaccaaatattagaggagaatatggacgtcgagatctggacaaaagaaggagagaaaaagaagctaagacccagatggctcgacgcaagaacctactccgaccctctcgcgctaaaagagtttaaggatttcgcagctggacgaaagtcgattgccctggaccttgttacagaaataggccgcgtccccagccacctggcgcataggactcggaatgctctagataatcttgtaatgttacacaccagcgaacacggaggccgtgcgtatcgacacgccgttgaggaactgcccgagacaatggaaactctcctcctcctaggacttatgatcttactcacgggaggagcgatgctattcctaatatcggggaaaggcatcggaaaaacctccattgggctaatttgcgtaatagctagtagcggtatgctgtggatggcagagatcccactacaatggatcgcctcagcgatcgtgttagagttcttcatgatggtgctactcataccggagcctgaaaaacaaaggaccccacaagataaccagttggcatacgtagtcattggaatactaactcttgcagccataatagcagccaatgaaatggggcttctggagaccaccaaacgagatttagggatgagcaaagaacctggggtggtatcgcctaccagctacctcgacgtagacttacacccggccagtgcctggacgctctacgctgttgctacaactgtcataacacccatgttaagacacaccatagaaaactcaaccgcaaacgtgagcctagccgcaatcgccaaccaagctgtagtactaatggggcttgacaaggggtggccgatcagcaaaatggacctgggagtgccactcttagccctcgggtgctacagccaagttaacccgctgacactgacggctgcagtcttgctactgataacacattacgcgatcataggacccggactgcaagccaaagcgacgcgagaagcacagaagaggaccgcagcaggcatcatgaagaacccgaccgtagacggcatcatgacaatcgaccttgatcccgtgatctacgactcgaagttcgaaaagcaactaggtcaagtaatgctcctagttctctgcgcggtacaactgctcctaatgagaacctcatgggcactctgcgaagcattgaccctcgccaccgggcccatcacgacgttatgggaaggctcaccaggaaaattctggaataccaccatcgctgtgagcatggcaaatatcttccgaggctcatacctcgcaggagccggcctcgccttcagcattatgaagagtgttggtacaggcaaacggggaactgggagtcagggtgaaaccctaggggaaaaatggaagaagaaactgaaccaattaagccggaaagagtttgacctgtataaaaagtcaggcataacggaagtcgaccgcacagaggcaaaagaaggactaaaaaggggcgagataactcatcacgccgtgtctcggggatccgccaaactgcaatggtttgtagagcgaaacatggtcataccagaggggcgagtgatcgacctcggctgtggccgaggcggttggagttactattgtgcgggccttaaaaaggtaacagaagtcaggggctatacaaaaggaggccccggacacgaggaaccggtcccaatgtctacatacggatggaacatagtcaagctaatgtcaggcaaggatgttttctaccttcccccagaaaagtgcgacacactgttatgcgatattggtgaaagctccccgtccccgactgttgaagagagccgcaccatacgggtgctcaaaatggtcgaaccgtggttgaagaataatcaattttgcataaaggtattaaacccctacatgccgaccgtgattgaacaccttgagagactccagcgcaaacacggcgggatgctcgtccgcaaccctctaagtagaaattccacacacgaaatgtactggatatcaaatggcacaggaaacatagtggccagtgtaaatatggtgagccgactccttctgaaccgcttcacgatgacgcaccgaagaccgacaatagagaaagacgtcgacttgggcgcaggcacgaggcacgtaaacgcggaaccggagacccccaatatggacgtaataggtgaaaggataaaacggattaaagaagaacataactcgacctggcattacgacgatgagaacccatacaagacctgggcctaccacggctcatacgaagtgaaagccaccgggtccgcgagctcaatgataaacggggtcgttaaactgctcactaagccgtgggatgtcgtacctatggtaacccaaatggccatgaccgacaccaccccattcggacagcaacgggtctttaaagaaaaagttgacacccgaactccacgcagtatgccgggaacccgccgagtaatgggcattacggccgagtggctctggcggacattagggcgcaataaaaagccaagactatgcacacgggaagagttcacaaagaaggtacgaacgaacgctgcaatgggagcggtctttacagaagagaatcaatgggactctgcgaaagcagccgtcgaagacgaagacttctggaagctcgtggacagagagcgcgagctacacaaactcggaaaatgcggcagctgtgtctacaatatgatgggcaagcgcgagaagaaactcggtgagttcggaaaagcaaagggaagccgcgcaatctggtatatgtggctgggtgcacgatacctcgaatttgaggcactgggctttttgaacgaagaccactggttctcaagagaaaactcctactccggcgtcgaaggcgaaggcctacacaagctcggctacattctgcgagacatttcaaaaatcccgggcggagccatgtacgcagatgacacggctggatgggacacccgaataaccgaagacgacctccacaacgaagaaaagataacacaacaaatggaccccgagcaccgacaactcgcaaacgcgatattcaaactaacctaccaaaataaggtcgtgaaagtacaacggcccacacccacaggaacggtcatggacatcatatcccgcaaggatcaaagaggtagcggacaggtaggcacatacggactgaatacgtttaccaacatggaggcgcaactgatacgccaaatggaaggagaaggagtcctctcaaaagccgacctggaaaacccccaccttcccgagaagaaaatcacgcaatggctagaaacaaagggagtcgaaaggttaaagcggatggcaatatcaggggatgattgcgttgtcaaaccaatcgacgacaggtttgcgaatgcactgcttgccctgaacgacatggggaaggtccgcaaagacataccacaatggcagccatcaaaagggtggcacgattggcaacaagtaccattctgctctcaccacttccacgaactaatcatgaaggacggccgaaaactcgtcgtgccctgccgcccgcaggacgaactgataggcagagcccgcatcagtcagggcgcaggatggagcctcagagaaactgcatgtcttggcaaggcatacgcccagatgtggagcctaatgtacttccaccgacgcgatctacggcttgcatccaacgcgatatgctcagcggtcccagttcattgggttccgactagccgaacaacctggtcgatccatgcccaccaccagtggatgacaacggaagacatgctaacggtctggaatcgtgtatggattgaagacaacccatggatggaagataaaacccccgtaacaacatgggaaaacgttccatacctaggaaaacgggaagaccagtggtgcgggtcactcatcggtttgacttcgagagcaacatgggcgcagaacatcccaacagcaatacaacaagtccggtcactcattggtaacgaggagtttcttgattatatgccgagcatgaagcggtttagaaaagaagaggagtccgaaggggccatctggtag

SEQ ID NO: 26185 - RNA, 9873 nt, synthetic construct
  misc_feature 1..9873: note = derived and/or modified CDS sequence (opt11) from DENV-3__AY858037__SS-prME
  source 1..9873: mol_type = other RNA
acatctctgtgtctcatgatgatgctgcccgtcaccctggccttccacctcacgtcccgcgacggggagccgcggatgatcgtcgggaagaatgaacggggcaagagcctgctgttcaagactgcctccgggattaacatgtgcacactcattgcgatggacctgggcgagatgtgcgacgataccgtaacatataagtgccccctgatcacagaggtggagcccgaggacatagactgctggtgcaatttaacttcgacctgggtgacttatgggacctgcaaccaggccggcgagcaccgtcgcgataagaggtcggtggccttagcaccccacgtggggatgggcttagacacccgcgcccagacatggatgtccgccgagggcgcctggaggcaggttgaaaaggtggagacgtgggctttccgccacccggggttcaccatcttggcccttttcctggcgcattatatcggcacatctctcacccaaaaggtggtcatctttatcctcctgatgctcgtgacgccaagcatgaccatgaggtgtgtgggggtcggtaaccgcgacttcgtggagggcttgtccggggccacgtgggtggacgtagtactggagcacggcggttgcgtgaccacgatggcgaagaataagcctaccttggacatcgagctgcagaagaccgaggcaacccaactggccacactcaggaagctctgcatagaaggcaagatcaccaacgtgacaacagacagccgctgccccacacagggcgaggcaatcctccctgaggaacaggatcagaactatgtgtgtaagcacacctacgtggaccggggatggggcaacgggtgcggcctcttcggcaagggatccctcgtaacctgcgctaagttccagtgcctcgaaagcatcgagggaaaggtggtgcagcacgagaatctcaagtacaccgtcattattacggtgcacacaggtgaccagcatcaggtcggaaacgagacccagggggtcacagccgagatcacgccacaggcgtccaccgtggaggccatactgccagagtacggaacccttgggctcgaatgcagccctcgcacagggctggacttcaacgagatgatcctgttaaccatgaagaataaggcctggatggtccaccgacagtggttcttcgatttaccgctgccctggacgtccggcgcaacaacagagactccgacgtggaataagaaggaactccttgtgaccttcaagaacgcccacgccaagaaacaggaggtagtagtgctggggagccaggagggagccatgcacaccgcgctcacaggtgccacggaaatccagacctccggtgggacctctatcttcgccggccatctgaagtgtcgcctcaagatggacaagctcgagctgaagggcatgtcctacgcaatgtgcagcaatgcctttgtactgaagaaggaggtcagcgaaacccagcacgggacgatcctcatcaaagtagagtacaagggcgaggacgcgccctgtaagatcccgttctcaactgaggacgggcagggcaaggcccataacggccgtttaattaccgccaaccccgtggtcaccaaaaaggaggaacccgtgaacattgaagccgagcctccgttcggggagagcaacatcatcatcggcatcggggaccgggcgctgaagatcaactggtataagaagggctcgagcatcgggaaaatgttcgaggccactgcgagaggggcccgtcggatggcaatcctgggcgacaccgcgtgggacttcggtagcgtgggcggcgtcctcaatagcctggggaagatggtgcatcagatctttgggagtgcctatacggccttattctcgggcgtttcctggatcatgaagatcggtatcggcgtcctcctgacctggatcggcctgaacagcaagaacacgtccatgtcgttctcctgcatcgtgatcgggatcatcaccttatatctgggggccgtagtacaggcggatatgggctgcgtgatcaattggaagggcaaggagctgaagtgcggctcaggaatctttgtgaccaacgaggtccacacttggactgagcagtacaagtttcaggcagattcccccaaacgtctcgccacggcaatagccggcgcctgggagaacggggtctgcggcatccgtagcaccacccggatggagaatctgctgtggaaacagatcgcaaatgaactaaactacatcctgtgggagaacaacatcaaactgacggtggtcgtgggagacatcataggcgtgctcgagcagggcaagcgcaccctgaccccacagcccatggaactgaagtactcatggaagacctgggggaaagccaagatcgtcaccgccgaaacccaaaactcttccttcataattgacgggcccaatacacccgagtgcccaaacgccagccgggcctggaacgtgtgggaagtggaggactacgggttcggcgttttcacgactaacatctggcttaagttaagggagatgtacacccagctttgtgaccatcggctgatgtcagccgcagtgaaggacgagcgcgccgtgcacgccgacatgggttactggatcgagtcccagaagaacgggagctggaagctggagaaagcatccctgatcgaggtcaagacctgcacctggccgaaatcccacaccctctggtccaacggtgtgctggagagcgacatgatcatcccgaagtccctggccggacccatctctcagcataactacagacccggctaccacacgcaaaccgcggggccgtggcacctcggcaagctggagctggactttaattactgtgagggcaccaccgtcgtcatcacggaaaactgcgggacccgcggccccagcctccgaacgacgacagtgagcgggaagctgatccacgagtggtgctgtaggtcatgcaccctacctcccctgaggtacatgggcgaggacggctgctggtacggtatggagatccgccccatcaacgagaaagaggagaacatggtcaagtcactggttagcgccggctctggcaaggtggacaacttcacaatgggcgtgttgtgcctagccatcttattcgaagaggtcatgagggggaagttcggtaagaagcacatgatcgcgggtgtgctgttcaccttcgttttactgctctccggccagatcacctggcgcgatatggcgcggacgcttatcatgatcggcagcaacgcctcggaccgtatggggatgggcgttacatatctggcgctaatcgccacgttcaagatccagccgttccttgcgctggggttcttcctgagaaagttaaccagccgcgagaaccttctcctcggcgtgggcctggccatggcaacgaccctgcaactccccgaggacatcgagcagatggcaaacgggatcgcgctgggattaatggccctcaaactgatcactcagttcgagacgtaccagttatggaccgccctcgtgtcattaatgtgttccaacactatcttcaccttgacagtcgcatggcggaccgccaccttaatcctagcaggcatatcactcttccccgtgtgtcagtccagctccatgaggaagacagactggctcccgatgacggtcgccgccatgggcgtacccccgctgcccctcttcattttctcccttaaggacaccttaaagcgccggtcctggccactgaacgaaggtgtcatggccgtcggcctcgtgtcgattcttgcttccagcttactgcgcaacgatgtgcccatggcggggccccttgtcgctgggggcctgctcatagcctgctacgtgataaccggcacctcggcagacctcacggtggagaaagccgcggacgtcacttgggaggaggaggccgaacagaccggggtgagccacaacctgatgataacagtggacgacgacgggacgatgaggatcaaagacgacgagaccgagaacatcctaaccgtcttactgaaaaccgcgctgctgattgtctccggtatcttcccctactcgattccggcaacccttctggtgtggcatacttggcagaaacaaacccagcgctccggcgtcctttgggacgtgcccagtcccccagagacccagaaggctgagctggaggagggcgtataccggatcaagcagcagggcatcttcgggaagacccaggtcggtgtgggagttcaaaaggagggcgtcttccacacgatgtggcatgtgacgcgcggagcggtactcacttacaatgggaaaagactcgagcccaattgggccagtgtcaagaaggatctgatcagctacggagggggctggcgcttgtccgcacaatggcagaagggtgaggaagtccaggtgatcgccgtcgaacccggcaaaaatcccaagaacttccagaccatgccgggcatcttccagacgaccaccggtgagatcggcgcaatcgccctagacttcaaaccgggtaccagcggcagccctatcataaaccgggaaggaaaggtagtggggctgtacggcaacggagtcgtgaccaagaatggcggctacgtgtccggcatcgcccagacgaacgctgagccggacggccccacacccgagctggaagaagaaatgtttaagaagcgcaacctcaccataatggacctgcaccctgggtccggcaagacgcggaagtatctccccgccatagtgcgagaggcgatcaagcggcgcctccggaccctaatactggcccctacacgcgtcgtggccgcggagatggaggaagccctcaaggggctgccgatccggtaccagaccacggccaccaagagtgagcatacgggcaaggagatcgtcgacttgatgtgccatgccaccttcaccatgcgcctcctgagccccgtgcgggtaccgaactataacctgatcatcatggacgaagcacatttcaccgacccggccagcatcgccgccagggggtacatctcgacccgtgtcggcatgggcgaggctgccgcaatatttatgaccgcgacgccacccggtactgccgacgccttcccccaatccaacgccccgatccaggacgaggagcgcgatatccctgagaggtcttggaactctggcaacgactggattacggacttcgccgggaagaccgtctggtttgtacccagcataaaggcggggaacgacattgccaactgcttgaggaagaacggcaaaaaggtcatccagctttcccgcaaaacgttcgataccgaataccagaagaccaaacttaatgactgggacttcgttgtgaccacggacatttccgagatgggagcaaacttcaaagccgaccgggtcattgaccctagaaggtgtctcaagcccgttatcctgactgacggccccgagcgagtgatcctggcgggtcccatgcccgtcaccgtggcgtctgcggcccagagacgcggccgggtcgggcggaacccgcagaaggaaaacgaccagtacatattcaccggccagcctctcaacaacgatgaggatcacgcacattggacggaggcgaagatgctgctggacaacataaatacgcccgagggcatcatcccagctttattcgagcccgagcgggagaaaagcgccgccatcgacggcgaatacagactgaagggcgaatcccggaagaccttcgtggaactgatgcgccggggagacctcccagtgtggttggcccataaggtcgcgagcgagggcataaagtataccgaccgcaagtggtgctttgacggagagcggaacaaccaaatcctggaagaaaacatggatgttgagatctggaccaaggaaggcgagaagaaaaagctacgccctcggtggctggacgcacgcacctattccgaccctctcgccctcaaggaatttaaagacttcgcggctggccgcaagagcatcgcgctggacctagtgactgagatcgggagggtcccgtcccatctcgcccaccgaactcgcaacgccttggacaaccttgtaatgcttcacaccagcgagcacggcggccgcgcttacaggcacgccgtggaggagctgcccgaaacaatggaaaccctgcttctgctgggcttaatgattctgttaactggaggcgcgatgctattcttaatcagcggaaagggggtcggcaagacatccattggtctaatctgcgtggtcgcaagctccggcatgctctggatggccgacatacccctacagtggatcgcttctgccatcgtcctggaatttttcatgatggtgctcttaatcccggagcccgagaagcagcgcacgccccaggacaatcagctggcgtacgtagtcattgggatcctgaccctggccgcaatcgttgcagccaacgagatggggctgcttgagacgaccaagcgggatctgggcatgtcaaaagagcccggcgtggtcagcccgacctcctaccttgacgtcgaccttcatcccgcgtcggcttggaccctgtacgccgttgctactacggtcatcacgcccatgcttcgccatactatcgagaactcaacagcgaacgtgtctcttgccgccatcgccaaccaggccgtggtcctgatgggcctggataaggggtggcccatctccaaaatggacctcggcgtgccacttctggcgctcgggtgctatagccaggtgaatcccctgacactgacggccgcagtcctcctgcttgtgactcactacgccataatcggcccaggactccaggccaaggcgacccgggaggcccagaagcgcacggccgccggtatcatgaagaaccccaccgtggacggcattatgaccattgacctggacccggtaatctatgacagcaagtttgagaagcaactgggacaggtgatgctcctggtcctgtgtgctgtccagctcttactgatgagaaccagctgggctttttgcgaagccctcaccctggccacggggcccatcacaaccctgtgggaaggctcccccggaaagttctggaacaccaccattgccgtgtcgatggcgaacatcttccgcggatcctacttggctggggccggactggccttcagcatcatgaagtccgtggggaccggaaagcgaggtaccgggagccagggcgagaccctgggcgaaaagtggaagaaaaagctcaaccagctaagccgcaaggagttcgacctgtacaagaagagtggcattaccgaggtcgatcggaccgaggcaaaggaggggttaaaacgcggcgagatcacccatcatgccgtaagccggggcagtgccaagctgcagtggtttgtagagcgcaatatggttatacccgaggggcgcgtgatcgacctgggttgcggccgcggcggatggagctactactgcgcaggcctcaagaaggtcaccgaggtgcggggatacactaaagggggcccggggcatgaggagcctgttcccatgagcacctacggctggaacatcgtgaaacttatgagcgggaaggatgtattctacctgcccccggaaaaatgcgatacgcttttatgtgacattggcgagagtagcccgtccccaaccgtggaggagagtcgaaccatcagagtgctgaagatggtcgagccgtggctgaagaacaatcagttctgtattaaggtcctcaacccctatatgcccacggtcatcgagcacctggagcggttgcagcgcaaacacggaggaatgttggtccgaaaccccctgtccagaaattcgacccacgaaatgtactggatttccaacggcaccggcaacattgtgtcttcggtgaacatggtctcccggctgctacttaaccgcttcaccatgacgtaccggcgccctacaatcgaaaaggacgtggacctgggggcgggcacaagacacgtcaacgccgagccagagaccccgaatatggacgtcatcggggagcgcatccggcgcatcaaggaggagcactcctctacatggcactacgacgatgaaaacccctacaaaacttgggcataccacggctcgtacgaggtcaaggccaccggatccgcaagctctatgataaacggagtcgttaagctcctgactaagccgtgggacgtagtccccacggtgacgcagatggctatgaccgacacaacgcccttcgggcaacagcgggtgttcaaagaaaaggtcgacacacgcacgcccaagccgatgcccggcacccggaaagtgatggagatcactgccgaatggctgtggcgcaccctcggccgtaacaagaggccccggctgtgcacccgcgaggagttcacaaagaaggtgcgtaccaacgcggccatgggggccgtcttcacggaagagaatcagtgggacagcgcccgggcggccgtggaggacgaggaattttggaagctggtggatcgcgagcgagagctccataagctgggcaagtgcgggtcctgtgtctacaatatgatgggcaagcgggagaagaaacttggggagttcggcaaggccaagggtagccgggcaatatggtatatgtggctcggggcccgctacttagagttcgaggcgctgggcttcttgaacgaggaccactggttctcccgggagaacagctactccggggttgagggcgaggggctgcacaagctagggtacatcctccgggacatctcaaaaatccccgggggtgccatgtacgccgacgataccgccggctgggatacaagaatcacggaggacgacctgcacaacgaggagaagatcacgcaacagatggacccggagcaccgccaactggccaacgcgatcttcaagctaacctaccaaaacaaagttgtgaaagtgcaacggcctacccccaaggggactgtaatggacatcatctcccgcaaagaccagcgaggaagcggccaagtagggacctacggcctgaacacattcaccaacatggaggcccagctgatccgccaaatggaaggggagggcgtgctctccaagaccgacctggagaacccgcatctgctcgagaagaaaatcacgcagtggctggagaccaaaggggtggagcggctgaaacgcatggcgatcagcggcgatgactgcgtcgtgaagcccatagacgaccgattcgccaacgccctcctggcgctgaacgacatggggaaggtgcgcaaggatatcccccagtggcagccctcgaagggttggcacgattggcagcaggtccctttttgtagtcaccacttccatgagctcatcatgaaggacggccggaagttggtggtcccctgccgcccccaggacgaactgatcgggcgggcacgcatctcccaaggggccgggtggtcactcaaggagaccgcatgcctggggaaagcctatgcgcagatgtgggccctgatgtacttccaccgccgtgatttgcgcctggccagcaacgccatttgtagcgcagtgccagtgcactgggtgcccacctcccggaccacatggagcatccacgcccatcaccagtggatgaccacagaggacatgctgacggtctggaaccgcgtatggatcgaagacaacccgtggatggaggacaagacccccgtgaccacctgggaggacgtcccgtatctcggaaaacgggaagatcagtggtgcgggagcctgatcggactaacgtcccgcgccacctgggcccagaacatcctcaccgccatccagcaggttcgctcgctgattggcaacgaggagttcctggactacatgccctccatgaagcgatttcggaaggaagaggagagcgagggcgcgatctggtga

SEQ ID NO: 26186 - RNA, 9873 nt, synthetic construct
  misc_feature 1..9873: note = derived and/or modified CDS sequence (opt11) from DENV-3__KJ737429__SS-prME
  source 1..9873: mol_type = other RNA
acaagcctatgcctgatgatgatgctaccagcaaccctggcgttccatctaacaagccgcgacggggagcctcgcatgatagtcggtaagaacgaacgggggaaatccctattattcaaaacggcgtccggtattaacatgtgcactctgatagcaatggacctgggcgaaatgtgtgacgacacagtcacttataaatgcccactcatagccgaggtcgagccagaggacatcgattgctggtgtaatctgacgtctacgtgggtgacatacgggacgtgcaaccaagcaggcgagcacaggcgcgacaagcgcagcgtcgcgttggcgccacatgttggcatgggactcgatacgcggacccagacctggatgagtgccgaaggggcctggcgtcaagtagagaaagtagaaacatgggcgctacgccaccccggcttcacgatcctcgctttgttcctcgcacactacataggcaccagcttaacacaaaaagtcgttatatttatcctactgatgctcgtaaccccctccatgacgatgagatgtgtaggtgtagggaacagagacttcgtggagggcttatcgggcgccacatgggtggatgtggttctagaacacggaggctgtgttacgacgatggctaagaacaagccaaccctcgacattgagttacaaaaaacggaggccacgcagctagcaacacttagaaaactatgcattgaaggaaaaataacgaacattaccacagactcgagatgtccgacacaaggcgaagcgatccttccggaggaacaagaccaaaactacgtgtgcaaacacacgtacgtagaccgcgggtggggcaacggctgcggcctgttcggaaaaggctccctggtaacttgcgcgaagttccaatgtctcgaaccaatagaaggaaaggtggtacaatacgaaaacctgaaatacaccgtaatcatcaccgtgcacacaggcgaccaacaccaagtcggaaacgatacacaaggagtaacggtggagataacaccgcaagccagcacagtagaagcagtgctcccggagtacggcaccttaggtcttgaatgctcaccgcgcaccggcctagatttcaacgaaatgatcctacttacgatgaagaacaaggcttggatggtacatcgacaatggttttttgacctaccgctcccctggacaagtggggcaaccacggagacgccaacatggaaccgcaaggaactattagtaaccttcaaaaacgcgcacgccaaaaaacaagaagtagtcgtactaggaagccaggaaggtgcgatgcacacggccctgacgggggctacggaaattcagaactccggtgggaccagtatctttgctggccacctaaaatgtagactgaagatggacaagctagaactaaagggaatgtcatacgccatgtgcttaaacaccttcgtactgaaaaaagaggtgagcgagacccaacacggcactatcctgatcaaggttgagtataaaggagaagacgccccgtgcaaaatccccttctccactgaggatggtcaaggaaaggcccacaacggaagattgatcacagcgaatcccgtagtcaccaaaaaagaggaaccagtgaacatcgaagcggagccccccttcggtgaatcaaacatagttataggaatcggagacaaagcgctcaaaataaactggtacaaaaaggggtcttcgatagggaaaatgttcgaggcaacggcacgcggcgcacggcggatggccatcctaggcgacacggcttgggactttggatcagttggaggcgttctcaactcactgggaaagatggtgcaccagatattcggttccgcgtatacagcgctattctcaggcgtttcctggattatgaaaatagggatcggagtactcttaacgtggataggcctcaacagcaagaacacttctatgtcgttcagttgcattgtaattggcatcataacgctatatctaggagcagtagtccaagcggacatggggtgcgttataaattggaaaggaaaggaactgaagtgcgggtccggtatcttcgttacgaacgaggtacacacgtggacagagcagtacaagttccaagcggacagccccaagagactcgcaacagcgatcgcaggagcttgggaaaacggcgtatgtggaatccgatcgaccaccagaatggaaaatctactttggaaacaaatcgccaatgagctaaactacatcctgtgggagaacaatatcaagctaacggtggtcgtgggagacatcattggggtgctggaacagggcaaacgcaccctgactccccaaccaatggaactgaaatacagttggaagacctggggaaaagcaaaaattgttaccgccgaaacacagaacagcagcttcatcatagacgggccgaatactccggaatgcccgtcagccagtcgcgcttggaatgtgtgggaggttgaggattacggatttggagtattcacaaccaatatatggctgaaactaagagaggtgtacacccagtcctgcgaccaccgcctcatgagcgcagcaataaaagacgaacgtgctgtgcatgccgacatgggctactggatcgagtcccaaaaaaacgggagttggaaactcgaaaaagcgagcttcatagaggtaaagacctgtacttggcccaagtctcacacgctatggagcaacggggtattggagtccgacatgataataccaaagtccctcgccggccccatatcacaacacaaccaccgccctggataccacacgcaaaccgcaggaccttggcatctaggcaagctagagcttgacttcaattactgcgaaggaactacagtcgtcataaccgaaaactgcggcactagaggaccttcactcaggactacgactgtaagtgggaaacttatccacgaatggtgttgtcgcagctgtaccctcccacccctgagatatatgggagaagacgggtgttggtacggaatggaaatccggccaatcaacgaaaaggaggaaaacatggtgaaaagtctagtatccgcagggtcaggaaaggtagacaactttacgatgggggtattatgcctcgcaatccttttcgaggaagtgatgaggggaaaatttggaaaaaaacacatgattgccggagtattgtttacgttcgtactactactctcaggtcagatcacatggcgagacatggcccacacgctcattatgatcggatcgaatgcaagcgacagaatggggatgggcgtcacatacctagctctaatcgcgaccttcaaaatacaacctttcctggcactggggttcttccttcggaaactgaccagccgtgagaacctcctactaggggtcggcttagccatggcgacaacacttcagctacctgaagatattgagcaaatggctaacggaatcgccctagggctaatgacgttgaaactaatcacacaattcgaaacgtaccaactatggaccgcgctagtgtccctaacatgctccaacacgatattcactctgaccgtagcatggcgaacagcgacgctgatcctcgccggagtgtcgctcctgccactgtgtcagagctcctctatgcgcaaaacagactggctaccgatgacggtcgctgcaatgggagttccacccctaccactcttcattttctccctaaaagacaccccaaaacgaaggtcttggcccctgaacgaaggagtcatggccgtaggactcgtgagtatactcgcgagctcactccttcgcaacgatgtcccgatggcgggccccctcgtcgcgggcggactgctaattgcgtgctatgtaattacgggaacaagcgctgacctcaccgttgaaaaggccgcggacgtcacatgggaggaggaggcggaacagactggagttagccataacctcatgatcacggtcgacgacgacggaacgatgcgaataaaggacgacgagacagagaacatattgactgtcctgctcaaaacggccctactaatcgtaagcgggatcttcccgtactcgatcccagcgacgttactggtctggcatacatggcaaaagcagacacaaagatcgggagtcttgtgggacgtaccatcacccccagaaactcagaaggcggagttagaagaaggcgtgtacagaataaaacagcagggaatattcgggaagacccaggtgggcgtaggggtacaaaaagaaggagtctttcacacaatgtggcacgtcacaagaggtgcagtcctcacacacaacggcaagagactggaacccaactgggccagcgtgaaaaaggacttaatctcttacggaggcggctggaggcttagcgcccagtggcaaaaaggagaagaagtccaagtaatagcagtagaacccggaaagaatccaaagaatttccaaaccatgcctggtatcttccaaacgacaacgggcgaaatcggagcgatagccctggacttcaaaccaggtacatcgggaagcccaataataaatcgggaagggaaggtcgtcggcctgtatggtaacggagtcgtgacaaaaaatggagggtacgtctcaggaatagcgcaaaccaacgctgagcctgacggaccaacaccggaactagaggaagagatgttcaaaaagcgaaacttgactataatggacctccaccctggatcaggaaaaacgcgcaaatacctacccgccatagttagagaggctataaagcgccgactacgaaccctaatattggcccccacacgagtagtagccgcggagatggaagaagccttgaaaggcttgccaatacggtaccaaactacagcaaccaagagcgagcatacaggccgcgagatcgttgatcttatgtgccacgcaacgttcacaatgagactactaagtccggtcagagtcccgaactacaatctaataattatggacgaggcgcacttcaccgatccggccagtatagccgcgcgggggtacatcagcacaagagtcggcatgggggaggcagcagcaatatttatgactgccactccgcctgggacagcagaggcatttccgcagagcaacgcacccattcaggacgaggagcgggacatccccgaacggtcttggaacagcgggaacgaatggataacggactttgtaggcaagacagtctggtttgtacccagtataaaggcgggcaatgatatagccaactgcctgcgcaaaaatgggaaaaaagtaatacaactgtcgagaaagacctttgatactgagtatcaaaagacgaggctgaacgattgggacttcgtcgtaacaacggacatctcggaaatgggggccaactttaaagcagaccgggtgatagatccacgccggtgcctcaaaccggtcatactcaccgacggaccggagagggtgatcttagccgggccgatgccggtaacagccgccagtgcagcacagagaagaggccgcgtaggacgaaacccgcaaaaagaaaacgaccagtatatcttcaccggacaacccttaaacaacgacgaggaccacgcacattggacagaagcgaaaatgctcctagataacataaacacgcctgaaggtatcataccagcacttttcgagccggaacgagaaaaaagcgcagccatcgatggcgaataccgcttaaaaggagaaagcagaaagacgttcgtcgaactgatgagacgcggagacttacctgtctggctcgcacacaaagttgcaagcgagggcattaaatacactgacagaaaatggtgtttcgatggcgagcgcaacaatcaaatcttggaagaaaacatggatgtggaaatatggacgaaggagggtgaacgaaaaaaactcaggccacgctggctagacgcaagaacatacagcgacccactggcccttaaggaatttaaagacttcgcggcagggaggaaaagcatcgcgcttgacctagtgactgagatcggacgcgtcccaagccaccttgcacacaggacgcgcaatgccttagacaacttagtcatgctccacaccagcgaacatggggggagagcctatcgtcacgcggttgaagagctccccgagacgatggagaccctgctactgctcggccttatgatactattgacgggcggggcgatgctattcctgatctctggcaaggggattggaaaaaccagcataggtttgatctgcgtgatagtgagctccgggatgctctggatggcagatgtaccactgcagtggatagcatcagcaatagtactcgaattcttcatgatggttctactcattccagagccggagaaacagagaacgccgcaggacaaccaactggcttatgtggtgatcggtatactcaccttggcagccatcgtagcggcaaacgaaatgggactactcgagacaacaaaaagagacctaggaatgtcaaaagaaccaggagtagtctcaccaacaagttacctggacgttgatctacatcccgcaagcgcatggactctatacgccgtagcaacaacggtgatcacacccatgctcaggcacaccatagaaaatagcacagctaacgttagtctcgccgcaatcgccaaccaagccgttgtactgatgggactcgacaaggggtggcccatatcgaagatggacctcggcgtacccctcctagcactgggatgctacagccaagtcaacccactcacactcaccgccgccgtattactcctcgtcacccactacgcgataatcggtccaggactccaggcaaaagctacgcgggaagcccaaaaacgaacagctgcaggcatcatgaaaaatcccacagtcgacggtatcatgaccatagaccttgaccccgtaatatacgactcaaaattcgaaaaacaactaggacaagtcatgttgctggtactctgtgcggtgcaactcctcctcatgcggacatcatgggcgctctgcgaagccctcaccctggcaacgggccctatcaccaccttatgggaggggagcccggggaagttctggaacacaacaatcgccgtcagcatggcaaacatcttcaggggatcctacttagccggagcaggtctagcgttctcgattatgaaaagcgtagggacggggcgtcgtgggacaggatcgcagggagaaacccttggcgagaagtggaagaaaaagctcaaccagttaagcagaaaagagttcgacctgtacaagaaaagcggcatcacagaagtcgatagaacagaagcaaaagaaggcctcaaaagaggagaaacaacgcatcatgctgtgtcaagagggagcgcaaaactgcaatggttcgtcgaacgcaatatggtgataccggaagggagagtaatcgatcttggctgtggcagggggggctggtcttactactgcgcgggtctaaagaaggtaaccgaggtccgaggatacactaagggcggcccgggccacgaagaacccgtccccatgagcacctatgggtggaacatcgtaaaactaatgagcgggaaagatgtattctaccttccgcccgaaaagtgcgacactctgctatgcgacataggagagagctctccaagccccacagtcgaagaatcgcggacaatacgggtgctaaaaatggttgaaccatggctaaaaaacaaccaattctgcattaaagtgctcaatccctacatgccaaccgtcatagaacacctagagagactccaaagaaagtatggcgggatgttagtacgcaatccactatcccgaaacagcacacacgagatgtattggataagcaacggaacgggcaatatagtaagctcagtaaacatggtaagcagattacttctaaaccggttcacaatgacacataggcggccaacaatcgaaaaggatgtcgacctcggcgcaggaacccgacacgtaaacgcagagcccgaaacaccgaatatggacgtgatcggtgaaagaataaagcggataaaagaggagcactccagtacatggcactacgacgacgaaaacccttacaagacctgggcataccacggctcttacgaagtcaaagcaaccggtagcgcaagctcaatgatcaacggcgtcgtcaaactattgaccaagccctgggacgtcgtaccaatggtcacacagatggctatgacggacacgaccccatttggtcagcaaagagtgttcaaagaaaaggtagatacgagaacaccaagaccgatgccaggtacacgtaaagtaatggagatcacggcggaatggctctggcggacgcttggacggaacaaaaaaccccgcctatgtacgcgcgaggagttcacaaagaaggtgcgaacaaacgcagcaatgggggcggtatttaccgaggagaatcaatgggattcggcgagagcagcagtagaggatgaggagttttggaagctggtggacagggagcgcgagttacacaaactgggaaaatgtggctcatgcgtgtacaacatgatgggtaaacgagaaaagaaattaggcgaattcgggaaagccaagggcagcagagcaatatggtatatgtggttgggagccagatacctagaattcgaagcgctagggttcctaaatgaggaccattggttcagccgtgaaaactcctatagcggagtcgaaggagagggcctacacaaactgggatacatactacgggacataagtaagatccccggcggcgctatgtatgccgatgatacagctggctgggacaccagaatcaccgaagacgatttgcacaacgaggagaaaattactcagcaaatggacccagaacacaggcaactcgcgaacgcgatattcaaattaacataccaaaacaaagttgttaaggtccaaagacccacccctaaaggcacggtgatggacattatctcacgcaaggaccagagagggtcgggacaggtgggaacctacggattaaacaccttcaccaacatggaggcccaactagtgcgacagatggagggcgagggcgtcctttcgaaggctgacctcgaaaatccccacctactagagaagaaaataacacaatggttagaaactaagggggtggagcgccttaagcggatggccatctcgggtgacgactgcgtagtaaaacccatagacgatagatttgccaacgccctccttgcacttaacgacatgggaaaagtacgcaaggacataccacaatggcagccctcgaaaggatggcacgactggcaacaggtcccattttgtagccaccactttcatgagctaataatgaaagacgggcgcaaattggtggtgccgtgtcggccccaagacgagcttataggacgggccagaatatcacaaggagccggttggagtctcaaggagacagcatgtctggggaaagcgtacgcccagatgtggtcgttaatgtactttcaccggcgagacctacgcctcgcctcgaacgcaatttgctccgcagtcccggtacactgggtaccaacatcacgaacaacatggagcatccatgcgcaccatcagtggatgactacggaggacatgttgacggtctggaaccgcgtctggatcgaggataacccgtggatggaggataaaacgccagtgacaacgtgggaggacgtcccatacctaggcaaaagagaagaccagtggtgcggcagcctcataggtctgacctcccgagccacgtgggcgcaaaacattttgaccgcaatacagcaagtcaggtcactgataggggacgaagaatttctagactatatgccatccatgaaaagattccgaaaagaagaggagagtgagggagcaatctggtga

SEQ ID NO: 26187 - RNA, 9873 nt, synthetic construct
  misc_feature 1..9873: note = derived and/or modified CDS sequence (opt11) from DENV-3__DQ863638__SS-prME
  source 1..9873: mol_type = other RNA
acgagcctttgtctcatgatgatgctgccggcgacgttagcattccacctcaccagccgggacggcgagccccggatgatcgtcgggaaaaatgagcggggcaagagcttactgttcaagactgcatccgggatcaatatgtgcaccctgatagcaatggatctcggcgagatgtgcgacgacaccgtgacctacaagtgcccccatattgcagaagtggagcctgaggacatcgattgctggtgtaacctgaccagcacctgggtaacatatggcacgtgcaatcaagccggggagcaccggcgcgataaacggtccgtggccttagcgcctcacgttggcatgggtctggacacccgcacccaaacgtggatgtccgctgagggcgcctggagacaggtggagaaggtcgagacgtgggccctgcgccaccccgggttcacaatcctcgcgctgttcctggcccattacatcggcacctccctcactcagaaggtggtgatattcattctcctaattttggttacgcctagcatggcaatgcgctgcgtgggggtgggcaacagggacttcgtcgagggcttgtcaggggccacttgggtcgacgtggtcctagaacacggtgggtgcgtgaccaccatggccaaaaacaaacctacgctcgacatagagctccagaagaccgaggctacacagctggccacattacggaagctgtgcatagagggcaaaatcacaaatatcaccaccgacagccgctgccccacccagggagaagcgatcctgcccgaggaacaggaccagaactacgtttgcaagcacacttacgtcgaccggggctggggcaacgggtgcggcctctttggcaagggctccctcgtgacctgcgccaagttccagtgtctagagtcgatcgagggcaaggtggtccagcacgagaacctcaagtacaccgtgattatcactgtgcacactggtgaccagcaccaagtcggaaacgagactcagggggtgaccgccgaaataacgccccaagcctctacggtcgaggctatcctgcccgagtacggcaccttgggcctcgagtgcagcccccgcaccggcctggatttcaatgaaatgatcctgttgaccatgaagaataaggcctggatggtgcacaggcaatggttctttgacctgccgttaccatggacctccggcgccacgaccgagacccccacatggaataggaaggaactccttgttacgtttaagaacgcccacgcgaagaagcaggaggtagtggtgctggggagccaggagggcgcgatgcataccgcgctcactggggctactgagatccagaactcaggagggaccagtatcttcgccggccacctaaagtgccgtctgaagatggacaaactcgagctaaagggcatgtcctacgcgatgtgcctgaatacctttgtcttgaaaaaggaggtgtccgaaacccaacacgggacgatcctgatcaaggtggagtacaagggtgaggacgctccttgtaagataccgttttcaacggaagacgggcaaggcaaggcgcataacggtaggctgatcactgctaatcccgtggtgaccaagaaggaggaacccgtgaacattgaggcagaacctccgttcggggagtccaacattgtaatcggcattggggataaggccctaaagataaactggtacaagaagggcagcagtatcgggaaaatgttcgaagcgacagcacgcggggcacgccggatggcgatcctcggagatacggcatgggacttcgggagcgtgggcggtgtactaaattccctgggtaagatggttcaccaaatcttcggaagcgcttacaccgccctgttctcgggcgtgtcgtggatcatgaagatcggcatcggtgtactcttgacgtggataggcctgaactccaaaaacacgtcaatgtccttcagctgcattgccatcgggatcatcaccttgtatctgggcgcggtcgtgcaggccgacatggggtgtgttatcaactggaaagggaaggagttaaagtgcggctcagggatcttcgtcacaaacgaggttcatacttggaccgagcaatataaattccaagcagacagcccaaagcgtctggccacagcgatcgcgggcgcctgggagaatggggtgtgcggcatccgctccacgacccgaatggagaacctgctctggaaacagatcgccaacgagctgaattacatcctgtgggagaataacatcaagctcaccgtggtggtcggggacatcataggcgtgctagaacagggcaagcgcacactcacgccccagcccatggagctcaagtacagctggaaaacctggggcaaggccaagatcgtcaccgcggagacgcagaacagttcgttcataatcgacggaccgcacactcctgagtgccccagggccagccgcgcttggaacgtgtgggaggtcgaggactacggattcggcgtgttcacgacgaacatctggctcaagctgagggaagaatacacgcagttatgcgaccatcggctcatgagcgcagctgtcaaggacgaaagagcggtccacgcagacatgggatactggatcgagtcccagaagaacggatcttggaagctcgaaaaggccagcctcatcgaagtgaagacatgtacctggcccaagtcccataccctgtggagcaacggggttctggagtccgacatgataatccctaagagcttggcggggccaatctcccagcacaaccaccgcccgggctaccacacccagacggcgggaccctggcatctgggcaagctggagctcgacttcaactattgtgagggcaccacagtcgtgatcaccgagaactgcgggacgcggggcccctcactgcgcaccaccaccgtgagcgggaagctcatccacgagtggtgttgccggtcttgcacactgccacccctccggtacatgggcgaggacgggtgctggtatggcatggaaattcggccgataaacgaaaaagaggaaaacatggtcaaatcactggcgagcgccggctccggaaaggtagacaacttcaccatggggttcctctgtctcgccatcctctttgaagaagttatgcgagggaaattcggtaagaaacatatgatcgccggggtctttttaacctttctgcttctcctgtcgggccagatcacctggcgggacatggcccacacactgatcatgatcggctccaatgcgagcgaccgaatggggatgggggtaacctacctcgcgctgatagccacctttaagattcagcccttcctggccctcgggttcttcctccgaaaactgaccagccgcgagaactttctcctgggcgtgggcctggcaatggcgacgactttacagctgcccgaagatatcgaacagatggccaacggaatcgccctgggcctcatggctctcaagctgatcacgcaatttgaaacctaccaactctggactgcgctggtctcgttgacctgcagcaacacgatcttcactttaacggtcgcctggcggactgctacgctgatcttagccggagtgtccctcctgcccgtctgtcagtcatcctcgatgcgcaagaccgactggcttccgatggcagttgcggccatgggcgtgcctcccctgccactcttcatcttctctctgaaggacacgctcaagcgccggagctggccgctgaacgaaggagtgatggctgtggggctggtcagtatattggccagctccctgttgcgcaacgatgtgcccatggccggaccccttgtggctggagggttgctgatcgcgtgctacgtcataaccgggaccagcgccgacctcaccgtggaaaaggccgcggacgtaacctgggaagaggaggctgagcagactggggtctcccacaacttaatgatcactgtcgatgatgacgggacgatgcgaatcaaggacgacgagacggagaacatactgaccgtactgctgaagaccgccctgctcatcgtctccggcatattcccctactccattcctgcgaccctgctcgtgtggcacacctggcaaaaacagacgcagagatcgggcgtgctctgggacgtccctagcccgccggagactcagaaagccgagctggaggagggagtgtaccggatcaagcagcagggaatcttcggaaagacccaggtgggcgttggggtgcagaaggaaggcgtgtttcacaccatgtggcatgtcacgagaggcgcggtgctgacccacaacggtaagcggctcgaaccgaactgggcgagcgtcaagaaggacctgatctcctacggcggtggctggcgcctaagcgcccagtggcaaaagggggaagaggtccaggtgatagccgtggaacctggcaagaaccccaaaaacttccagaccatgcctggcatcttccaaacaacgaccggggagataggggccattgcgctggacttcaaaccagggacctcgggctcgcctattatcaaccgagaaggaaaggtcgtgggcctctacggcaatggggtggtcaccaagaacggtgggtacgtctctggtatcgcccagacgaatgctgaaccagacggcccaacccctgaactggaggaggagatgttcaagaagcgcaacctgacgatcatggatctccaccccgggtccggcaagacccgaaaatacttacccgccatcgtgcgcgaggccatcaaaaggcgcctgcggacgctcattctggcgccgactcgcgtcgtggccgccgagatggaggaagccctgaaggggcttcccatccggtaccaaaccactgcaacaaagtccgagcacaccggccgggagatcgtggacctgatgtgccacgcgaccttcacaatgcggctgttgtctcctgtccgtgtgcccaattataacttaatcatcatggacgaggcccattttacggacccggcgagcatcgcggcacgggggtatatctctacccgcgttggcatgggggaggccgccgctatcttcatgactgccacgccacccgggaccgcggatgcgttcccccaaagcaacgccccgatccaagacgaggaacgcgacatccccgagaggtcctggaactccggcaacgagtggatcaccgatttcgtgggaaagacagtgtggttcgtgccctccatcaaagccggaaacgacatcgccaattgcctgagaaagaacgggaagaaagtcatccagttaagccggaagacgttcgacacggagtaccagaagactaagctgaacgactgggacttcgttgtgacaaccgacatctccgagatgggcgccaactttaaggccgaccgggttatcgaccctagaaggtgtttgaagcctgtgatcctcaccgatggccccgagcgggtcatcctggccgggcctatgcccgtcacggccgcctcagcagctcaacgccggggacgcgtgggacggaacccgcagaaggaaaacgatcaatacatcttccggggccagcccttaaacaacgacgaggatcacgcccattggactgaggcgaagatgttactagacaatatcaacaccccagaggggatcatacccgcgctgttcgagcccgagcgggagaagtcggccgccatcgacggtgagtaccgcctcaaaggcgaatccaggaagacgtttgtggagctgatgcgccgcggggacctgcccgtctggctcgcacataaggtcgccagcgaggggatcaagtacaccgaccgcaagtggtgtttcgatggggagaggaataaccagatcctagaggagaacatggacgttgagatatggaccaaggagggcgagaagaaaaagctgcgcccccgatggctcgacgcacggacctacagcgaccctctggccttaaaggagtttaaggacttcgctgccggcaggaaatctattgccctagatctggtcaccgagattgggcgggttccgtcgcacctcgcccaccgtacgcgtaacgctctcgacaatctggtcatgttacacacttccgagcacggtgggcgcgcctaccggcacgccgtagaggaactccccgaaaccatggagaccctgctgctcctgggtctgatgatcctcctgacaggtggggccatgttgttcctcatcagcgggaaggggatcggcaagactagcatagggctgatctgcgttattgcaagtagcggcatgctctggatggccgacgtacccctacagtggatcgcatccgccatcgtgttggagttctttatgatggtcctgctcatcccggaacccgagaagcagagaactccccaggataatcagctggcctacgtagtgatcgggatcctgaccttggcggccatagtggccgcaaacgagatgggccttctggagacgaccaagcgggatctcggaatgagcaaagagcccggagtcgtatccccaacatcatacctggatgtggacctgcaccccgcttccgcgtggaccctctacgccgtcgccaccacggtgatcacccccatgcttcgccacacgatcgagaacagcactgcaaacgtgtccctggcggccatcgctaatcaggcagtcgtgttaatgggcctcgacaagggatggcccatctctaagatggacctgggcgtgccgctccttgccctggggtgttattcccaggtaaatcccctcaccctgacggccgccgtgctactcctggccacccactatgccataatcggccccggtctacaagccaaagcgacgcgggaagcccagaaacgcaccgcggccggtatcaccaagaacccaaccgtggacggcatcatgacgatcgaccttgacccagtcatttacgatagcaagttcgagaagcagcttggccaggtgatgctccttgtgttgtgtgccgtgcagctgctcttaatgcggacctcctgggccctgtgcgaggctctgaccctggctaccggacccatcacgaccctgtgggagggtagccccggcaaattttggaacaccacaatcgccgtgtcaatggcgaacatctttcggggctcgtacctcgcaggggccggtttggcgttcagtatcatgaagtccgttgggacgggcaagcgggggaccgggtcccaaggcgagaccttaggggaaaagtggaaaaagaagctcaaccagctgagccgcaaggagttcgacctgtacaagaagtccggtatcacagaagttgaccgcacggaagccaaggaggggctcaaacgcggtgagataacccggcatgctgtgtcccgcggttctgccaagctgcagtggttcgtggagcggaacatggtaatccccgaggggcgcgtcatcgaccttgggtgcgggcgcggcgggtggtcgtattactgcgccggactcaagaaggtgacagaggtccggggctacacaaagggcggccctgggcacgaggagcccgtgcccatgagcacctacggctggaacatcgtgaagctgatgagtgggaaggacgtcttctacctgcctccggagaagtgcgacacgctgttatgcgacatcggcgagagctccccctcccccaccgtagaggagtcccgcacaatccgggtgctgaagatggtcgagccttggctgaagaacaaccagttctgcatcaaggtgcttaacccgtacatgcctacggttatcgaacacctggagcgcctgcagcggaagcacggcggaatgcttgtacgcaacccgcttagccgaaacagtacacacgagatgtattggataagcaacggcaccgggaacattgtctccagcgtgaacatggtctcccgcctgcttctcaaccggttcaccatgacccaccgccggccgacgatcgagaaggacgtggacctgggagccggcacgcgccacgtaaacgccgagccggagacacccaacatggacgtaataggggagcggatcaagcgcatcaaggaggagcacaatagcacctggcactacgacgacgagaacccctacaagacatgggcttaccacggctcctacgaagtgaaggcaaccgggtcagcctccagcatgataaacggagtagtcaaactcctgactaaaccctgggatgttgttccgatggtaatccagatggccatgaccgatacgacccccttcgggcaacagcgggtgttcaaagaaaaggtcgacacccgcactccccggcctatgcccggcaccaggaaggtgatggaaatcaccgctgagtggctgtggaggaccctcgggcgcaacaagcgcccccggctgtgtaccagggaagaatttacgaagaaggtgcggaccaacgccgctatgggggccgtcttcaccgaggagaaccagtgggacagcgccagagcggccgtagaggacgaggagttctggaaactggtggacagggaacgcgaattgcataagctgggcaagtgcgggagttgcgtctacaacatgatgggaaagcgcgagaagaagttaggagagttcgggaaggccaagggctcgcgcgccatctggtacatgtggctcggagcccggtacttggagttcgaggcgctgggatttttcaacgaggaccattggttctcgcgcgagaacagctactccggtgtggagggcgaggggttgcacaaactaggctatattctgagagacatcagcaagatccccggtggagcgatgtatgccgacgataccgccggctgggacacgcgcatcaccgaagacgacttgcacaatgaggagaagataactcagcagatggatccggagcaccggcaattggccaacgcgatctttaagttgacctaccagaacaaagtggtaaaggtgcagcggcccacgcccaaggggaccgtaatggatatcattagccggaaagaccagcgcggaagcggccaggtagggacgtacggcctcaacactttcaccaacatggaagcccaactggtacgacaaatggagggggagggcgtgctttccaaggccgacctcgagaacccacatctcctggagaagaagattacacagtggttagaaaccaagggggtcgagcgcctcaaaagaatggccatcagcggcgacgactgcgttgtaaagccaattgacgaccggttcgccaacgccctgctcgcgttgaatgacatgggcaaagtccgaaaggacataccgcagtggcagccctcgaaggggtggcatgactggcaacaggtccccttctgctctcaccacttccacgagctgatcatgaaggacggcaggaagctcgtggtcccgtgccgcccacaggacgagctgatcggtcgggccagaatctccagaggcgctgggtggagcttgaaggaaacagcatgcctcggaaaggcctatgctcagatgtggtcgctgatgtacttccaccgacgcgatttgcgcctggcctcgaacgccatctgcagtgcggtgcccgtacattgggttcctaccagccgcacgacctggagcatccacgcccaccatcagtggatgaccactgaggacatgctgacggtctggaacagggtgtggatcgaggacaacccgtggatggaggacaagacccccgtaacgacctgggaagatgtaccgtatctgggtaaacgcgaggaccaatggtgtgggtcactcatcggactgacgagccgcgctacatgggcccagaatatcctgaccgcgatccagcaggtccgttccttgatagggaatgaggagttcctggattacatgccgtcgatgaaacgcttcaagaaggaggaggagagcgagggagcaatctggtaa

SEQ ID NO: 26188 - RNA, 9873 nt, synthetic construct
  misc_feature 1..9873: note = derived and/or modified CDS sequence (opt11) from DENV-3__KJ737430__SS-prME
  source 1..9873: mol_type = other RNA
acgagcctgtgccttatgatgatgttacccgccaccctggctttccacctcacctcccgcgacggcgaaccccggatgatcgtgggcaagaacgaacggggtaagagccttctgttcaagactgcgtctgggatcaatatgtgcaccctcatcgctatggatcttggggagatgtgcgacgataccgtcacgtacaagtgccccctgatagccgaggtggagcccgaggacatcgactgctggtgcaatctcaccagcacctgggtcacctacgggacgtgcaaccaggcgggcgagcaccggcgcgacaaacggtcagtcgccctggcgccccatgtcgggatgggtctggacaccagaacccagacctggatgagcgcggaaggtgcctggcgccaggtggagaaggtcgagacgtgggcgctccggcatcctgggttcaccatcctggcgctgttcctggcccactatatcggcacgtccctgacccaaaaggttgtgatattcatcctgctcatgctcgtcacgcccagtatggccatgcggtgtgtaggcgtgggcaaccgcgatttcgtagaaggcctgtccggggccacctgggtggacgtggtcctcgaacacggagggtgtgttaccacgatggccaaaaataagcctacactagatatcgagctgcaaaagactgaggcgacccagctcgccacgttacgaaagctgtgtattgagggcaagattacaaacatcaccaccgacagccgctgccccacccagggcgaggccatcctcccggaggaacaggatcagaactatgtctgtaagcatacgtacgttgatcgggggtggggcaacggttgcggcctgttcgggaagggctccctggtaacctgcgcaaagttccagtgtttagagagcatcgagggcaaggtggtccagcacgaaaacctgaaatacaccgtgatcatcaccgtgcacacgggggaccagcaccaggtcggcaacgacactcaaggggtgaccgtcgagatcacccctcaggcctccacggttgaagctatcctgcccgagtatggcaccctcgggctggagtgcagcccccgcactggcctggacttcaacgagatgatcctactgaccatgaagaacaaggcctggatggttcaccgccagtggttcttcgacctacctcttccctggacctccggtgccacgacggagactcccacctggaaccgcaaggagctgcttgtcacgtttaagaacgcccacgccaagaaacaagaggtggtggtcctcgggtcacaggaaggcgcgatgcacaccgccctgacgggggccacagagatacagaactccggcgggacgagcatctttgcgggccacctcaaatgccggctcaagatggacaaactggagctcaagggcatgtcctatgcgatgtgcctcaacaccttcgtgctgaagaaggaggttagcgaaacacagcacgggaccatcctgatcaaggtcgaatacaagggggaagacgccccgtgcaaaatcccgttcagcacagaggacgggcagggcaaggcccataacggccggctgatcaccgcaaatcccgtggtaaccaagaaggaggagcccgtcaacatcgaagccgagccacccttcggggaatccaatatcgtgatcggcatcggggacaaggcgctcaagattaattggtacaagaagggaagctcaatcggcaagatgttcgaagccaccgcccggggagcccggcggatggcaatcttaggcgataccgcgtgggattttggttctgtcggcggggtccttaactccctcggaaagatggtgcaccagatcttcgggagcgcctacacagccctgttctccggcgtgagctggataatgaagataggcatcggggtgctgctcacctggataggcctgaactcgaagaacacctccatgtccttttcctgcatcgccatcgggatcatcacgttatatctcggtgccgtggtgcaggcggacatggggtgcgtcatcaattggaagggaaaggagctcaagtgcggctccgggatcttcgtgaccaacgaggtgcacacctggaccgagcagtataagttccaggcagatagccctaagcggctggccacggccatcgccggcgcgtgggaaaacggggtctgcggtatccgcagcacgacccggatggagaacctgctgtggaagcagatcgccaacgagctaaattacatcctatgggagaacaacatcaagctgaccgtggtggtgggggacatcattggcgtgctggagcaaggcaagcgcactctcactccccagcctatggagctgaagtacagctggaaaacttgggggaaggctaagatcgtcaccgcagagacgcagaactccagcttcatcatcgacggcccaaatacccccgagtgcccctctgcgagccgggcctggaacgtctgggaagttgaggactacggtttcggcgtttttaccaccaacatctggcttaagctccgcgaggtctatactcaatcgtgcgaccatcggctaatgtcggccgcaatcaaggacgaacgggccgtgcacgctgacatgggatactggatcgagagccaaaagaacgggtcctggaagctggagaaggcttcatttatagaggtaaagacatgcacctggcccaagtcgcacaccttatggagcaacggagtcctggagagcgacatgataatcccgaagagtctggccgggcccatctcacagcacaaccaccgtcccggctaccacacccaaaccgccgggccgtggcacctgggcaagctggagctagacttcaactactgcgagggcaccactgtggtgatcacagagaattgcgggacgcggggccctagcctccggactacaaccgtgtccgggaagctgatccatgaatggtgctgccgctcgtgcacactgccacccctcaggtacatgggcgaggacgggtgctggtacggaatggagatccgcccgatcaatgagaaggaggaaaatatggtaaagtcactggtctccgccggctccggaaaggtcgacaacttcacgatgggcgtgctatgtctggcgatattgttcgaggaagttatgcggggcaagttcggcaagaagcacatgatagccggggtcctattcacctttgttctcctgcttagcggccagatcacctggcgtgacatggcccacacgctcatcatgatcggtagcaacgccagcgaccgaatgggaatgggagtgacctacctggccctcatcgcgaccttcaagatccaacccttcctcgctctgggctttttcctgcgcaaactcacctctcgggaaaacctactgctcggtgtcggcctggctatggccacgacccttcagctccccgaggacatcgagcagatggcgaacggaatagccctgggcctgatggctctcaaactgattacccagttcgagacctaccagttatggacggccctcgtatccctgacgtgctcgaacaccatcttcaccctgacagtcgcttggaggaccgcgaccctcatcctggcaggggtctccctgctacccgtgtgccagagctcgtcgatgcggaagaccgactggctgccgatggccgtcgccgccatgggcgtgccgccactgcccttgttcatcttctccctgaaggacacgctgaagcgcagatcctggcccctcaacgaaggcgtgatggctgtcggcctggtgtccatcctggctagctccctccttcggaatgacgtgcccatggccggacccctggtcgcagggggcctgttaatcgcctgctacgtgatcaccgggacgagcgcggacctcaccgttgagaaggccgccgacgtcacgtgggaggaagaggcagagcagaccggcgtgtctcacaacctcatgattactgtggacgatgacggcaccatgcgaatcaaggacgatgagacggaaaacatccttaccgtcctgttaaagaccgccttacttatcgtgagcggcatcttcccatactccattccggcgaccctactggtgtggcacacctggcagaagcagacgcagcggagcggcgttctctgggacgtgcccagcccacccgagacgcagaaggcagagctcgaggagggggtgtaccgaatcaaacagcagggcatctttggcaagacccaggttggcgtaggcgtgcagaaggagggcgtcttccacaccatgtggcacgtgacgaggggcgccgtgctgacccacaacgggaagcgactggagccaaactgggccagcgtcaagaaggaccttatctcatatggtggtggctggcgtctgagcgcgcagtggcagaaaggagaggaggttcaggtgatcgccgtcgagcccggcaagaaccccaagaacttccagaccatgcccggcattttccagacgacgaccggggagattggcgccatcgctctggacttcaagccggggaccagcggatcccccatcatcaaccgcgagggcaaggtggtggggctctacggcaacggtgtcgtgaccaagaacggcgggtacgtcagcggcatcgcccagacgaacgccgaacccgacggcccgaccccagagctagaggaggaaatgttcaagaagcgaaatttgaccatcatggacctgcacccagggtccggcaagacccgcaagtacctccccgccatcgtccgtgaggctatcaagcgccgactacgtacgttgatcttagccccgacccgggtggtggccgcagaaatggaggaggccctgaaagggctgccgatccggtaccagaccaccgccactaagagcgagcacacgggtcgggagatcgtcgatctcatgtgccacgccaccttcaccatgcgcctgctgtcacccgtgcgcgtcccaaactacaacctgatcatcatggacgaggcccacttcacagacccagcgagtatcgcggctagggggtacatttccaccagagtcggcatgggcgaggcagcggccattttcatgactgccacacctcccgggacggccgaagcgttcccccagagcaacgcaccgatccaggacgaagaacgcgatattcctgagcgatcctggaactcgggtaatgagtggattaccgacttcgttgggaagaccgtgtggttcgtcccctcaatcaaagccggtaacgacatcgcaaactgcctgcggaagaatgggaagaaggtgatccagctgtcccgcaagactttcgacacagagtatcagaagaccaaactcaacgattgggactttgtggtcaccacagacatctccgagatgggcgccaacttcaaggctgaccgagtgatcgacccccgccgatgcctgaagccagtgattctgacggacggccccgagcgcgtcatcctcgcggggccaatgcccgtgactgccgccagcgccgcgcagcggcgcggtagggtggggcgcaacccgcagaaggagaatgatcaatacatttttacaggccagcccctgaacaacgacgaggaccacgcgcactggaccgaggccaagatgctgcttgacaacatcaacacacccgaggggatcatcccagccctgttcgaaccggagcgggagaagtccgccgcgatagatggcgagtaccgcctaaagggtgagagccggaagacattcgtagagctcatgcgccgtggggacttgcccgtctggctggcacacaaggttgcctccgagggcatcaagtacaccgaccgaaagtggtgcttcgatggggaacggaataaccagatacttgaggagaatatggacgtggagatttggaccaaggagggcgagaggaagaagctgaggccgcgctggctggatgcccgaacctatagcgaccctctcgccctgaaggagttcaaggatttcgcggccggccggaagtccatcgccctggacctcgtgactgagatcgggcgtgtcccgagtcacctggcccaccggacgcgaaacgccctggacaatttggtgatgctgcacacctcggagcacggcggccgggcctaccgtcacgccgtagaggaactgcccgaaaccatggagaccctcttactgctaggactgatgatcctgctcaccgggggcgccatgctgttcctgatctcagggaagggaattggaaaaaccagcattgggctgatctgcgtcatcgtgtcctcgggcatgctgtggatggccgatgtgcccctccaatggatcgcctccgccatcgtcctcgaatttttcatgatggtcctgctgatcccggagcccgagaaacagcgaacaccccaggacaatcagctcgcctacgtcgtcattggtattctgacgcttgccgcgatcgtggcagcgaatgagatgggattgctggagaccaccaagcgtgatctgggcatgtcaaaggagcccggggtggtctccccgaccagctacctagacgtggacctgcatcccgcttccgcttggacgctgtacgccgttgcgaccaccgtcattacccccatgctacggcacacgatagagaacagtacagccaatgtgtcgctggccgccattgccaaccaggcggtggtcctgatggggcttgataaggggtggccaatcagtaagatggacttgggcgtgccactgttggctttggggtgctactcccaggtgaaccccctgaccctcaccgccgccgtcctgctactcgtgacgcactatgccattattggacccggcctccaggcgaaggccacccgagaggctcagaagcggacagccgccgggatcatgaagaaccctacggtggatggcatcatgacgattgacctggacccggtcatatacgatagcaagttcgagaaacagctcggacaggtgatgctccttgtgctctgcgcggtccagcttctgctcatgcgcacttcctgggccctgtgcgaggctctgacactcgccaccggcccaatcacgaccctttgggagggatctccaggcaagttctggaataccaccatcgcggtgtccatggccaacatcttccggggctcctatttggccggggccggtctcgcgttttccattatgaagtccgtgggaactggcaaaaggggcaccggtagccagggtgagacgttgggtgagaagtggaagaagaagctgaaccagttatcccgtaaggagtttgatctatacaagaaatctggcattaccgaggtcgatcgcacggaggcgaaggaggggttgaagaggggcgagaccactcatcacgccgtgtcccgcggcagcgccaaacttcagtggtttgttgagcggaacatggtcatccccgaggggcgcgtgatagaccttggctgcggacgaggcgggtggtcgtactactgcgccggcctgaagaaggtcactgaggttcgaggctacaccaaagggggcccgggacacgaggagccggtgccaatgagcacatatggctggaacattgtgaaactcatgagcgggaaggatgtcttctacctacccccggagaagtgcgacaccctgctatgcgacatcggcgagagcagtcctagccccaccgtcgaggaatcccgcactatcagggttctcaagatggtggagccctggctgaagaacaatcagttttgcatcaaggtgctgaacccgtacatgcccactgtgatagaacacctcgagcgcttacagcgaaaatacggcgggatgctcgtccgcaaccccctcagccggaactctactcatgagatgtattggatcagcaatggcacggggaatatcgtgtccagcgtgaatatggtcagtcggctgctgctcaaccggttcaccatgacgcaccgccggcccaccatcgagaaggacgtggacctgggcgccggcacccgccacgtcaacgcggaacccgagaccccaaacatggacgtgatcggagagcggatcaagcgcatcaaggaggagcattcgtccacgtggcattacgacgacgagaacccttacaaaacctgggcgtaccacggcagctacgaggtcaaagcaaccggtagcgcctcctcaatgatcaacggcgtcgttaagctgctcaccaagccatgggacgtagtccccatggtgatccaaatggccatgacggataccacccccttcggacagcaacgggtgtttaaagagaaagtcgatacccgcacgccccggcctatgcccggcacccggaaggtgatggagatcaccgcggagtggctctggaggaccctgggccgcaacaagcggccccgcctctgcacgcgcgaggagttcaccaagaaagtgcggaccaacgcggcaatgggggccgtttttaccgaagagaaccagtgggactccgcgagggctgccgtggaggacgaggagttctggaagctggtagatcgggagcgcgagctgcacaagctcgggaagtgcgggagctgcgtatacaacatgatgggcaaaagggagaagaagctgggggagttcggtaaggccaagggcagccgcgcaatctggtacatgtggctgggagcccggtacctcgagttcgaggccctgggattcttgaacgaggatcactggttcagccgcgagaactcctattcgggggtagagggcgaagggctccacaagctggggtacatcctgcgggacatctccaaaatacccggcggggccatgtatgccgacgatacggccggctgggacactcgcatcacggaggatgacctgcacaatgaagagaagatcacccagcagatggatccggagcaccggcagctggcgaacgccatcttcaagctgacgtaccagaacaaggtcgtaaaggtgcagcgccctacccccaaagggaccgtaatggacatcataagccggaaggaccagagaggctccggccaggtcggtacatacgggctcaacacgttcaccaacatggaggcccagctggtacggcagatggagggggagggcgtgctgagcaaggccgacctcgagaacccacaccttttagagaagaagatcactcagtggctcgagaccaagggggtcgagcgcctgaagcggatggctatatcaggcgacgactgtgttgtgaaacctatagacgaccgcttcgcgaatgccctgcttgccctgaacgacatgggtaaggtccgaaaggacatccctcaatggcagccaagcaaggggtggcacgactggcaacaggtgcccttctgttcccaccacttccacgagctgattatgaaggacggcaggaaactcgttgtcccttgccggccccaggacgagctgatcgggagagcgcgtatcagccagggcgccgggtggtcccttaaggagaccgcgtgcctcggaaaagcctacgcccagatgtggagtctgatgtatttccaccggcgcgatctgcggctggcctccaacgcgatctgctctgccgtacccgtgcactgggttccaacgtcccgcaccacctggagtatccacgcacaccaccaatggatgaccacggaggacatgctgaccgtgtggaacagagtttggatcgaggataatccgtggatggaggataagactccggtcaccacgtgggaggacgtgccatatctgggcaagcgcgaggaccaatggtgcgggagtcttatcggcctgacatccagagccacctgggcccagaacatcttgacagcgatccaacaggtacgcagtttaatcggcgacgaagagttcctggactacatgccctccatgaaaagatttcgcaaggaggaggaaagcgagggcgcaatctggtga

SEQ ID NO: 26189 - RNA, 9873 nt, synthetic construct
  misc_feature 1..9873: note = derived and/or modified CDS sequence (opt11) from DENV-3__AY858040__SS-prME
  source 1..9873: mol_type = other RNA
acctcgttgtgcctcatgatgatgctgccggcaaccctggccttccacctcacgtcccgcgacggcgaaccccggatgatcgtggggaagaacgagcgcggcaagagcctgctgttcaagaccgcttccgggatcaacatgtgcaccctcatcgcaatggacctgggcgagatgtgcgacgataccgtaacgtacaagtgccccctgattaccgaggtggagccggaggatatcgactgctggtgcaatctgactagcacctgggtcacgtacgggacctgcaaccaggccggcgaacaccggcgagacaagcgttccgtcgccctggctccccacgtggggatggggctggacacccgcgcgcaaacctggatgagcgccgagggcgcgtggagacaggtggagaaggtcgagacatgggccttccgccatccggggttcaccatactcgcgctgtttctggcccactacatcggtaccagtctcacccagaaggtggtgatattcatcctgctgatgctcgtcacaccctcaatgaccatgcggtgcgtgggggtgggcaaccgcgacttcgtggagggtctctccggggccacctgggtggacgtggtgctggagcacggcgggtgcgtgactacgatggctaagaacaagcccaccctcgacattgagctgcagaaaaccgaggcgacccagctggctacgctgcggaagctgtgcatcgagggcaagataactaacgttactaccgatagccgctgccccactcagggcgaggcgatactgcccgaggagcaagatcagaactatgtctgcaagcacacctacgtggaccgggggtggggcaacgggtgcggtctcttcgggaagggctcccttgtgacctgcgccaagttccagtgcctggaattaatcgagggcaaagtcgtccagcacgagaacttgaagtataccgttatcataacggtacacaccggggaccagcaccaggtgggcaatgagacccagggggtcacggcagagatcacgccacaggccagcaccgtggaagcgattctgcccgagtacggcaccctcgggctggagtgttcgccccgcaccggcctggacttcaacgagatgatcctcctgaccatgaagaacaaagcctggatggtgcaccggcagtggttcttcgacctgccgctcccctggacgagcggcgccaccacagaaacccccacttggaacaagaaagagctcctggtcaccttcaagaacgcccacgccaagaagcaggaagtcgtggtcctcgggtcccaggaaggcgcgatgcacaccgccttaaccggcgccacggagatccagacctccggcgggacctccatcttcgccggccacctgaagtgtcgcttgaagatggacaagctggagctgaaaggcatgagttatgccatgtgtagcaacgcgttcgtgctcaagaaggaggtgagcgagacccagcacgggacgatactcataaaggtcgagtacaagggcgaagacgccccctgcaaaatccccttcagcaccgaggacgggcagggcaaggcccacaacggccggttaatcaccgcaaaccccgttgtgaccaaaaaggaggagcccgtcaacatcgaggcggagcccccgtttggggagtccaacatcatcatcggcatcggagacaaggcccttaaaataaactggtataagaaaggtagcagcatcgggaagatgttcgaggccacggcacgcggcgcccggcgcatggcgatcctaggcgacaccgcctgggactttgggagcgtgggcggggtgctgaactctctgggtaagatggtccatcagattttcgggtctgcctacaccgccctcttcagcggcgtaagctggatcatgaagatcggcatcggggtgctgctgacctggattggcttaaacagcaagaacacgagcatgagcttcagctgcatcgtcatagggatcatcacgctgtacctgggcgccgtggtgcaggcggacatggggtgcgttattaactggaagggcaaggagctaaagtgcggctccgggatcttcgtcaccaacgaggtgcacacctggacggagcagtacaagttccaggcagacagccccaaacggctggccacagcgatcgccggcgcttgggaaaacggggtctgcggcatccggtccaccacccgcatggagaacctgctgtggaagcagatcgccaacgagctcaactacatcctgtgggagaacaatatcaaattaacggtggtcgtcggggacattatcggcgtcctggagcagggcaaacggaccctgacaccccagcctatggagctcaagtatagctggaagacttgggggaaggccaaaatcgtgacggctgagaagcagaactccagcttcatcatcgacgggccgaacaccccagagtgccccaacgcgtcacgagcctggaatgtctgggaggtggaggactacgggttcggcgtgttcaccaccaacatttggttgaagctgcgggaaatgtacacgcagctctgcgaccaccgcctgatgagcgctgccgtcaaggacgagcgggccgtgcacgcggacatgggttattggatcgaatctcagaagaacgggtcctggaagctggagaaagccagtctcatcgaggtgaagacatgtacctggcccaagtcccacaccctgtggagcaacggcgtcctggagtccgacatgattatccccaagagcctcgccgggcccatctcccagcataactaccgccccggctatcacacccagacggccgggccgtggcacctgggaaaactggagctcgacttcaattactgcgagggcacaaccgtggtgatcacggaaaactgcgggacgcggggtcccagcctgcgcaccaccacggtctccgggaaactgatccacgaatggtgctgccgcagctgcacgctaccacccttgcgctacatgggcgaggacgggtgctggtacggcatggagatcaggccaatcaacgagaaggaggagaatatggtgaagtcccttgtgagcgccggctccgggaaggtcgacaacttcacgatgggagtgctatgcctggcaatcctgttcgaggaggtcatgcgcgggaagttcggcaagaagcacatgatcgccggggtcctctttaccttcgtgctgttactcagcggccagatcacctggcgggacatggcccgcacgctgatcatgatcggttcaaacgccagcgaccggatggggatgggcgtgacctatctggccctcatagctaccttcaaaatccagcccttcctggccctgggcttcttcctccgcaagctgacctcccgggagaacctgctcctgggcgtcggcctggccatggctacgaccctccagctgcccgaggatatcgagcagatggcgaacgggatagccctgggcctcatggccctgaagctgatcacacagttcgagacctaccagttgtggacagccctggtaagcctgatgtgcagcaacacgatattcaccttgaccgtcgcctggcgcacggcgaccctgatcttagccgggatctccctcatgccagtctgccagagctcaagcatgcgcaagaccgactggctgccgatgactgtcgcagccatgggggtcccgcccctgcccctctttatcttcagtctgaaggacacgctgaagcgccgcagctggccgctcaacgagggggtgatggcggtcgggctggtatccattctggcgagctccctcctgcggaacgatgtgcctatggccggcccacttgtagccgggggcctcctaattgcctgctacgtgatcaccggtaccagtgccgacctgaccgtggagaaggccgccgacgtgacatgggaggaagaggccgagcagacaggtgtctctcacaacctcatgatcaccgtggacgacgacgggacaatgcgcatcaaggatgacgagacggagaacatcctgaccgtgctgctcaagaccgcgctgctgatcgtaagcggcatcttcccctactccatcccggccaccctcctggtgtggcacacctggcaaaagcagactcaacgcagcggcgtactgtgggacgtccccagcccacccgagacacagaaggcggagctcgaagaaggggtgtacagaatcaagcagcagggcatctttggtaaaacccaggtgggcgtcggggtgcagaaggagggcgtgttccacaccatgtggcacgtaactcggggcgctgtgctaacttacaacgggaagcgcctggagccgaactgggccagcgtgaagaaggacctcatctcctacggcgggggctggcggctgagcgcctactggcagaagggggaggaggtccaagtgatcgcggtggagcccggcaagaaccccaaaaacttccagactatgcctggaatcttccagaccacgactggggagatcggcgccattgctctggacttcaagccggggaccagtggcagccccatcatcaatcgcgagggaaaggtcgtggggctgtacggcaacggtgtggtaaccaagaacggcgggtacgtgagcggaatcgcccagacgaacgccgagccagacggcccgacccccgagctcgaggaagagatgtttaaaaagcggaacctgaccatcatggacctgcatcccgggtccggcaagacccgcaagtacctccccgcgatcgttcgggaagccatcaagcgccggctgcgcacgctgatcctcgccccgaccagagtagtagcggccgagatggaggaggctctgaaggggctgcccgttcgctaccagaccaccgcgacgaagtcagagcacacaggcaaggagatcgtcgacctcatgtgccacgctaccttcaccatgcggctgctgtcccccgtgcgcgtgcccaactacaacctcatcatcatggacgaggcccacttcacggacccggccagcatcgcggcacgggggtacatctcgacacgcgtcggcatgggcgaggccgcagcgatcttcatgactgccactcccccagggacggccgatgccttcccccagtccaacgccccgatacaggacgaggagcgggacatccccgagcgctcatggaacagcggcaacgattggataaccgatttcgcggggaagactgtgtggttcgtgccctcaatcaaggccggcaacgacatcgccaactgccttcgaaagaacgggaagaaggtcattcagctttctcggaagaccttcgatacagagtaccagaagaccaagttaaacgactgggacttcgtggtgacgaccgacatctccgagatgggcgccaacttcaaggccgaccgtgtcattgacccccggcgatgtctaaaaccggtgatactgacggacggcccggagcgggttatcttggcggggcctatgcccgttaccgtggccagcgccgcccagcgccgcggccgcgtggggcgcaacccgcagaaggagaatgaccagtacatcttcacaggccaaccgctgaacaacgatgaggaccacgcccactggacagaggcaaaaatgctgctcgacaacattaacactccggagggaataatccccgctttattcgagcctgagcgagagaagtccgccgctattgacggcgagtaccgtccgaagggcgagagccgcaagaccttcgtcgaactgatgcggcgcggggacctccccgtgtggctggcgcacaaggtcgcctccgagggcattaaatacacagaccgcaagtggtgctttgacggagagcgcaacaaccagatcctggaggagaacatggacgtcgagatttggaccaaggagggcgagaaaaagaagttacggccccgctggctcgacgcgcggacctacagcgacccgctggccctaaaagagttcaaggacttcgccgcgggacgcaagtccatcgccctggacttagtgacggagatcggccgagtcccgagccacctcgcccatcggacccgcaacgccctggacaacctggtcatgctccatacctctgaacacggcgggcgggcctaccgccacgcggtggaggaactgcccgagaccatggagacgttactcctgctgggcctcatgatcctgctgaccggtggagcgatgctattcctaatcagcgggaaaggtgtcggcaaaaccagcatcggtctgatatgcgtagtggcctcaagcggcatgctgtggatggccgacattccgttgcagtggatcgcgtctgcaatcgtcctggagtttttcatgatggtactcctgatccctgaacccgagaagcagcggacaccccaggacaaccagttggcttacgtggtcattgggatcctaacgctggccgcaattgtcgctgcgaacgagatgggcctgctcgagaccacaaagcgagacttgggcatgagcaaggagccgggggtggtctcccccaccagctacctggacgtggacctccaccccgcctccgcctggactctatacgccgtggcgaccacagttatcacccccatgttgcggcacacaattgagaacagcacagccaacgtgtccctcgctgccatcgcgaaccaggcggtggtcttgatgggcctggacaaggggtggccgatcagcaagatggacctcggcgtgcccctgctggccctcggatgctactcgcaagtgaaccccctgaccctgaccgccgccgtactcctgctggttactcactacgccataatcggccccggcctccaggcgaaggccacccgagaggcccagaagcgcacagctgccggaattatgaagaacccgaccgtggacggaatcatgacgatcgacctggaccccgtcatctacgacagcaagttcgagaagcagctgggacaggtgatgttactggtgctctgtgcggtccagctcttactgatgcgcacttcctgggccttctgcgaagcactcaccctggcgaccggccccatcacgaccctctgggagggcagccccgggaagttctggaacaccaccatcgcggtgtccatggccaacatcttccgaggaagctatctcgccggggccggactggccttctccattatgaagtctgtggggacgggaaagcgcggcaccgggtcccagggcgagactctgggcgaaaaatggaagaagaagctcaatcaactgagccggaaggagtttgacctgtacaagaagtccggcatcaccgaggttgaccgcacggaggcgaaggaggggctgaagcgcggcgagatcactcaccatgccgtgtcccgcgggtccgctaagctgcagtggtttgtggagcggaacatggtgatcccggaggggagggtgatcgacctgggctgcgggagaggcgggtggtcgtactattgcgccggcctcaagaaggtcaccgaggtccgaggctacacaaaagggggcccaggacatgaagaacccgtacccatgagcacctacggctggaacattgtgaagctgatgtccgggaaggacgtcttctatctgccgcccgagaagtgcgacacgctcctgtgtgacatcggcgagagctctccctcacccaccgtagaggaaagccggaccatccgcgtgctgaagatggtcgagccgtggctgaagaacaaccagttctgtatcaaggtgctcaacccttacatgcccaccgtcattgaacacctggagcgcctccagaggaagcacggagggatgctcgttcgtaatcccctaagccggaactcgactcacgagatgtactggatcagcaacggcacagggaacatcgtgtccagcgtgaacatggtttcccgccttctcctaaatcggtttaccatgacataccgccggccgacgatcgaaaaggacgtggatctgggcgctggcacccgccacgtcaacgcggagcccgagacccccaacatggacgtgatcggggagcggatccgccgaatcaaggaggagcacagctctacctggcactacgacgatgaaaacccgtataagacgtgggcctaccacggcagctacgaggtgaaagcaacggggtccgccagcagcatgatcaacggggtggtgaagctgttgactaagccctgggacgtggtccccaccgtgactcaaatggctatgaccgataccacccccttcgggcagcagcgcgtcttcaaggagaaagtggacacgcggaccccaaagccgatgccggggacccgtaaggtgatggagatcaccgcggagtggctgtggcggacgctgggccgcaacaagcggccacggctgtgtacccgggaggagttcaccaagaaggtgaggaccaacgccgccatgggggccgtattcacggaggagaatcagtgggactccgcgcgcgccgcggtagaagacgaggagttctggaagctggtggacagggagcgcgaactccacaaactcggcaagtgcgggagctgcgtctataacatgatgggaaaaagggagaagaaattgggcgagttcggcaaggccaagggcagccgcgccatctggtacatgtggctaggggcgcggtacctggagtttgaagccctcgggtttctgaacgaggaccattggttcagccgcgagaactcctacagcggtgtggagggcgagggcctgcacaagctgggctacatcttaagggacatctccaagatcccgggcggggccatgtatgccgacgacacagccggctgggacacccgcataacggaggacgacctgcacaacgaggagaagatcacgcagcagatggagcccgaacaccggcagttagcgaacgccatcttcaagctcacttaccagaacaaagtggtgaaagtgcagcgccccacccccaaagggaccgtgatggacatcattagccggaaggaccaacgcggctccggccaagtcgggacgtatggcctgaacaccttcaccaacatggaggcccagttgatccggcagatggagggggaggacgttttgagcaagaccgacctggagaacccgcatctgctcgagaagaagatcacccagtggttggagacgaaaggcgtggaacgcctgaagcggatggccatctccggtgacgactgcgtcgtgaaacccatcgatgaccgattcgccaacgcactcctggcactgaacgacatgggtaaggttcggaaggatatccctcagtggcagcccagcaagggctggcacgactggcagcaggtaccgttctgctcccaccacttccacgagctcatcatgaaggacgggcgcaaacttgtggtcccctgccggccccaggacgagctcatcggccgcgccagaatctcgcagggggctggctggtctcttaaggagaccgcctgcctggggaaggcgtacgcccaaatgtgggccctgatgtacttccaccgccgcgacctccggctggcctcaaacgcgatctgctccgccgtccccgtgcactgggtgccaaccagcaggaccacgtggagcatccacgctcaccatcagtggatgaccaccgaggacatgctgactgtctggaatcgggtgtggatcgaggacaacccctggatggaggacaagacacccgtgactacctgggaggacgtcccctacctcggcaagcgcgaggaccagtggtgcggcagccttatcgggctgaccagtcgggccacgtgggcccagaacatcctcaccgcgatccagcaagtgcgcagtctgatcggcaacgaggagttcctggactacatgccgagcatgaagcggttccgcaaggaggaggaatccgagggggccatctggtga

SEQ ID NO: 26190 - RNA, 9873 nt, synthetic construct
  misc_feature 1..9873: note = derived and/or modified CDS sequence (opt11) from DENV-3__AY858041__SS-prME
  source 1..9873: mol_type = other RNA
acatctctatgtctaatgatgatgttgccggcaaccctagcattccacctgacatcgcgggacggagaacctcgaatgatcgtagggaaaaatgaacggggcaaaagtttactgttcaaaacagccagcggaataaacatgtgcaccctgatagctatggacctaggtgaaatgtgcgacgatacagttacatataaatgcccgctaataaccgaagtagaacccgaagacatagattgctggtgcaacctgacgagcacatgggtcacctatgggacctgtaaccaagcgggcgaacaccgccgggataaacgatccgtagcactagctccccacgtagggatggggctggatacaagggcgcaaacctggatgagcgcagaaggagcctggcgacaagtcgaaaaagtcgaaacgtgggcattccgccaccccgggttcaccatcctagcgttgtttctagcgcattacatcggcacatcactgactcaaaaagtagtcattttcattcttctcatgctagttacgcccagtatgaccatgcgctgtgtcggggtcggaaacagggacttcgtagaaggactatccggcgcgacgtgggtagacgtcgtcctcgaacatggcggatgcgtcacgacaatggccaaaaacaaacctacactcgatatcgaactccagaaaacggaagcaacgcaactcgcaacccttaggaaactctgcatagagggaaaaatcacaaacgtaacaaccgacagtcgctgccccacacagggcgaagccatcctaccagaagaacaagaccagaactacgtctgtaaacacacatacgttgaccgaggctggggcaatggatgcgggttattcggcaaaggatccctcgtcacatgcgcaaaattccaatgcctggaattgatagagggcaaagtcgtacagcacgaaaacctcaaatataccgtcatcattaccgttcacaccggagatcaacaccaagtggggaacgagacacagggagtaaccgcagagatcacgccccaagccagcacagtggaagctatactccccgaatacggtactttggggctcgaatgttcgccaaggacaggactcgacttcaacgaaatgatactcctgacaatgaaaaataaagcgtggatggtacacagacaatggttctttgatctcccgttaccctggaccagcggcgccacaactgaaactcccacctggaacaagaaagagctcctcgtaacattcaagaatgcacacgccaagaaacaggaagttgtagtactaggaagccaagagggggccatgcatacggcgctcaccggagccaccgagatccagacctcaggcgggacatccatttttgcaggccatctcaaatgccgcctaaagatggacaaactagaacttaaaggcatgtcctacgcgatgtgcagcaacgctttcgtgctaaagaaagaggtttcagagacacagcacggaacaatactaataaaagtagagtacaaaggggaggacgccccatgtaagatacccttctcgaccgaagacgggcaagggcaagcgcacaacggcagactaatcaccgcgaaccccgtggttacgaagaaagaggagccagtgaatatagaagcagaatctcccttcggcgaaagtaacattataatagggataggggacaaggccctcaagatcaactggtataagaaaggatcaagcatcggcaaaatgttcgaggctaccgcccgaggggccaggagaatggccatcctgggggacacggcatgggacttcggaagcgtaggtggagtcctaaatagtctaggcaagatggtacaccagatcttcgggtcggcgtacacagcgctattcagtggggtcagctggataatgaagataggcataggggtactcctaacttggatcggtcttaattcaaagaacacctcgatgtcattcagctgtatagtgattgggataataaccctatacctcggtgcagtggtacaggccgacatgggttgtgtaattaattggaagggcaaagaactgaaatgcggcagcggcatcttcgttacaaacgaagtacacacgtggactgagcagtacaagttccaggcagattcccccaaacgcctggcgactgcaatagcgggggcgtgggaaaacggtgtatgtggtatacgaagcaccacacgtatggaaaaccttttatggaagcagatagccaatgaactgaactacatcctctgggagaacaacattaagctaacagtcgttgtgggtgacataataggggtcttagaacagggcaagcgaacactcacgccacaaccaatggagctcaagtatagctggaagacatggggaaaggcaaaaatcgtaacggcggaaatacaaaattccagtttcatcatcgacggtccgaatacacccgagtgccctaacgcgagccgcgcctggaacgtatgggaagtcgaagactatggatttggagtgttcacaacaaatatatggctaaagttgagagagatgtacactcaattgtgcgaccatcggctcatgagcgcagcagtaaaagacgagcgcgccgttcacgcggatatggggtactggatagagagccaaaagaacggctcatggaaactggagaaggcttcactgatcgaggtcaaaacatgcacctggcccaaaagtcatacgctttggagcaacggcgtgctggagtccgacatgatcattccaaaatcactcgcagggccaataagccaacacaactacagaccaggctatcacacccagacggccggcccgtggcacctcggaaaactagagctcgacttcaactactgcgagggtaccacggtagtaattaccgaaaattgtggaaccagaggcccctcactccgcacaacgacagtgagtgggaagctgatccacgagtggtgctgcagatcctgcaccttaccgcccctgcgatatatgggtgacgatggttgttggtacggaatggaaatccgacccattaatgagaaggaggagaatatggtaaagtccctcgttagcgccggtagtggaaaggtcgacaacttcacgatgggcgtactgtgcctcgccatactcttcgaagaggttatgcggggcaaattcggcaagaagcacatgatagctggcgtcctgttcatgttcgttctcttgctcagcggccaaatcacatggagagacatggcgcggacactgataatgatcggctctaacgcaagtgacagaatggggatgggcgtcacttatctagcactcatcgccaccttcaagatccagcccttcttggcgctgggcttcttcctacgaaaactcacgtcgagggagaacctgctcctcggggtaggtctggcaatggccaccaccttgcaattacctgaggacatagaacaaatggcaaatggcatagccctcggactcatggcgttaaaattaataacacagtttgagacatatcagctatggactgcgttggtaagcctgacgtgcagcaacacaatcttcaccctaacggtagcctggcgcaccgcgacgcttatactagccggcatcagtttactgccggtttgccaatcgtctagcatgaggaagacggactggctacctatgacagtggctgcaatgggggtcccgccgctcccgctctttatcttcagtctcaaggacaccctaaagcgacgctcctggccactaaacgagggagtaatggcggtcgggctcgtttccatcctggcgagctccctacttcgcaacgacgtaccaatggctggtcctctagtagctggcggactgctgatagcgtgctacgtaatcaccgggaccagcgccgacctgaccgtggagaaagcggcagacgtaacctgggaggaagaagcagaacaaacgggagtatcacacaacctcatgatcacagtagacgacgacggcaccatgcggatcaaagacgacgaaaccgaaaatatactcaccgtactcctcaagaccgcactactgattgtatccggaatttttccatactccatacccgccacactgctggtgtggcacacgtggcaaaagcaaacccaaagaagtggtgtactatgggatgtaccctcaccacccgaaacacagaaggcggaattagaagaaggagtataccggatcaaacaacaagggatatttggaaagactcaagtgggggttggcgtacaaaaggagggtgtatttcacacgatgtggcacgtgacacgaggggcagttttaacctataacggcaaacgtcttgagccaaattgggcgtccgtcaagaaagatctcatatcctatggagggggctggcgactgagcgcccagtggaagaaaggggaagaggtccaagtcatagccgtcgaaccagggaaaaatcccaagaacttccagacgatgccaggaatatttcagacgaccacaggagagataggagccatagcactagacttcaagcccggcacgagcgggtcccctatcataaaccgcgaggggaaagtcgtgggcctatatggcaatggcgtcgtgaccaaaaatggcgggtacgtgtctggaattgcacaaacaaacgctgagcccgacggtccgaccccggagctcgaagaagaaatgttcaagaaacgaaatctgaccattatggatctacaccctggaagcggtaaaacccgcaaataccttccagctatagtgcgagaggcgatcaagcgacgactcagaacgctaatcctcgcacccacccgcgtcgtcgccgccgagatggaagaagcactcaaaggcctacccataagatatcagactacagcaacgaaatcggaacatacaggcaaggagatagtagaccttatgtgtcacgcaacgttcacaatgcgactgctaagtcccgtaagagtcccaaactacaatctaataatcatggacgaagcacacttcacggacccggcatcaatagcagcacggggctatatttcaacaagggtaggcatgggcgaggcagccgccatctttatgacggcgaccccgccggggacagccgacgcgttcccacaatcaaacgcaccgatccaagatgaagaacgcgatataccagaacggtcttggaacagtggtaacgattggataaccgacttcgcgggcaagaccgtgtggtttgtccccagcataaaggctgggaacgatatcgctaactgcctccgaaagaacggcaagaaagttatccaactatcgcggaaaaccttcgacactgaatatcagaagacgaagttaaacgactgggacttcgtagtaactaccgacatatcagagatgggggccaacttcaaagcagacagggtaatcgaccccaggcgatgcctaaaacccgtaatattgaccgacgggcctgaacgagtgatcctggcggggccgatgcccgtcacagtggcatcggccgcccagcggcgagggcgcgtaggacggaacccacaaaaggaaaatgatcagtacatcttcactggccagccgctcaacaatgacgaagaccacgcccactggacggaagcgaagatgctactggacaacataaataccccggaagggataatcccagcattgttcgagccagagcgggaaaagtccgccgccatagatggcgagtatagactcaaaggagaatcccggaagacatttgtggaactcatgcgacgcggcgacctaccggtctggctagcccacaaggtagcatcagagggaataaagtacacggaccgaaaatggtgcttcgacggcgaacggaataaccagatcctagaggagaacatggacgttgagatctggaccaaagagggcgagaagaagaaactcagacccagatggctcgacgcaaggacatattccgaccccttagcgctgaaagaatttaaagactttgcggccggtagaaaatcaatcgccttggacctagtcacagaaataggaagagttccgagccacctcgcccacagaacacgaaacgcattagacaatctagttatgctgcatacgtcggagcacgggggccgagcctatcgccacgctgtagaggagctaccagaaaccatggaaacgctcttgctgctaggcctgatgatattgctcacaggcggggcaatgcttttcctaatcagtgggaagggcgttgggaaaacgtcgatcgggctcatctgcgtggtggccagcagcggaatgctatggatggcagacatacccctgcagtggatagcatcggcaattgtcctagagttcttcatgatggtactactaatccccgaaccagagaagcaacgaacgcctcaagataatcaactcgcctatgttgttatcggaatacttaccttggccgccatcgtagccgcaaacgagatgggattgctcgagacaacgaagagggacctgggcatgtcaaaggagccgggggtcgtctcgtctacgagctatctagacgtagacctgcacccggcgtccgcgtggactttgtatgccgtggccacaactgtcatcacgccgatgctcaggcatacgatagaaaacagtaccgcaaacgtctcgttggccgcgatagcgaaccaggccgtagttctgatggggctggacaaagggtggccgatatccaaaatggatctaggcgtacccctactcgctctcggctgctactcgcaagtaaacccgttaaccctaacggccgcagtcctactcctagtaactcactacgcaataatcggccccggactccaagcgaaggcgacaagagaggcacagaaacgcaccgcagccgggatcatgaagaatcccacagttgacggcataatgacgatagacctcgacccagtgatatatgactccaagttcgaaaagcagctcgggcaagtaatgctcctcgtgctatgcgcggtccaactcctacttatgcgaaccagctgggccttctgcgaagcactcacgttggctacgggcccaattaccacactctgggagggctcaccgggaaaattctggaacacgaccatagcagtatccatggctaatatctttcgtggcagctatctagcaggagccggacttgccttctcgatcatgaaatcagttggaacaggcaaaagggggacagggagccaaggagaaacattaggggagaaatggaagaagaagctaaaccagctaagcaggaaagagttcgacttgtacaagaaatcaggaatcacagaagtagaccgaacggaagcaaaggaggggttaaaacggggagaaataacacaccacgccgtcagccgcggaagtgccaagctccaatggtttgtggaaagaaacatggttatcccggaagggagggtaatcgatttggggtgcgggcgcggaggatggtcatattactgtgcaggtctcaaaaaggtgacagaggttaggggatacactaaaggaggaccgggccacgaggaaccagtccccatgagcacttacggatggaacatcgtcaagctgatgagcgggaaggacgtgttttacctaccgcccgaaaaatgcgacactttgttgtgcgacataggggagagttcgccttcaccaacagtagaagagagccgaacgattcgcgtcctgaaaatggtcgaaccctggttgaaaaataaccagttttgcatcaaagtcctgaacccgtatatgccaacagtgatagaacatctcgaacggctacaacgtaaacacggaggcatgctagtacgaaacccgctaagtaggaactcgacacacgaaatgtattggatcagcaacggaaccggaaatatagtcagcagcgtaaacatggtgtccaggttacttctgaacaggttcactatgacctataggcgaccaacgattgagaaagatgtcgatttgggcgcaggcacaagacacgtcaacgcagaacctgaaaccccgaacatggacgtcatcggagaaagaataagacgaataaaagaggagcactcatcgacgtggcactacgacgacgaaaacccctacaagacgtgggcatatcacggctcctacgaggtcaaagctacaggctcggcaagctcaatgataaacggagtcgtcaaactgctcacgaagccttgggacgtagtgccaaccgtcacacagatggccatgactgacactacaccgttcggtcagcaaagggttttcaaagagaaagtcgatacgcgcacacccaagccaatgccagggactagaaaagtcatggaaatcacagccgaatggttatggcgcacgctgggaagaaacaagcgaccaagactatgcacacgagaggagttcacgaagaaagtccgaacgaacgcggcgatgggcgccgtattcaccgaagagaatcaatgggacagcgcgcgtgccgccgtcgaagacgaggagttctggaagctcgtcgacagagagcgggaactacataaacaaggcaaatgtggaagttgcgtatacaacatgatgggcaagcgcgagaagaaactcggtgagttcggaaaagctaagggatcgcgcgcaatatggtatatgtggcttggggcacgatacctcgagttcgaggccctgggcttcttgaacgaagaccactggttttctcgagaaaacagctattcaggtgtagaaggagagggcctacacaagctaggatacatcctaagagatatatccaaaatcccaggaggggcaatgtacgccgacgacaccgccggctgggacacacgcatcactgaagacgatctccataacgaagagaaaatcactcagcaaatggaccccgaacacaggcagctggcaaacgcaatattcaagctcacgtaccagaacaaggtggtcaaggtgcaaagacccacccctaaaggcacagtgatggacataatatcaaggaaagaccaacgaggttcgggacaagtaggcacatacgggctaaatacgttcacgaacatggaagcacaactaatacgccagatggaaggagaaggagttctctcaaaaaccgatctagaaaacccgcacctcctcgagaagaaaataacgcagtggttagaaaccaagggcgtggaaaggctgaaacgaatggccatatcaggggacgactgcgtagtaaaaccaatagacgacagattcgcgaacgcgctactggcacttaacgacatgggcaaagtccgaaaagacataccacaatggcaaccatcgaaaggatggcatgactggcaacaggtcccgttctgctcccaccatttccacgagttaataatgaaagacggaagaaagctggtcgttccctgccgtcctcaagatgaactgatcggacgtgcgagaataagtcaaggggcagggtggagcctaaaggaaacggcatgcttaggcaaggcatacgcacaaatgtgggcactcatgtactttcacagacgggacctacgactggctagcaacgccatatgtagcgcggttccagtacactgggtccccacttcgagaacaacatggagtatacacgcacaccaccagtggatgaccacggaggacatgctcacggtctggaatagggtatggatcgaggacaacccctggatggaagataagacgccagtaacaacatgggaagatgtcccatacctaggaaagagggaagatcaatggtgcggctcactgatcggacttacgtcgcgagcgacatgggcacagaacatccttactgcaatacaacaagtcagatccttgatcggcaatgaggagttcttagactacatgccgagcatgaagagatttagaaaggaagaggaatcagaaggagccatttggtga

SEQ ID NO: 26191 - RNA, 9873 nt, synthetic construct
  misc_feature 1..9873: note = derived and/or modified CDS sequence (opt11) from DENV-3__KC261634__SS-prME
  source 1..9873: mol_type = other RNA
acgagcatttgcctaatgatgatgttgccggcgactttagcgttccacctaacttcacgagatggggaaccgaggatgattgtagggaaaaacgaacgcggaaaaagtctattattcaaaacggcaagcgggataaacatgtgcaccctaattgcaatggacctcggagaaatgtgcgacgatacagttacctacaaatgcccactcattgcagaagtcgaacccgaagacattgattgctggtgcaacctaacgtcaacttgggttacatacggcacttgcaaccaagctggggaacaccggcgggacaaacgttccgtggccctcgcaccgcatgtcgggatgggactggacacgcgtacgcaaacgtggatgtccgcagaaggagcctggcgacaagtggaaaaagttgaaacctgggccctccggcatcccggcttcacgatcctagcgctctttctagcacattacataggaaccagtctaacgcagaaagtagttattttcatacttctgatgctggtaacgccgagcatgacgatgcgctgtgtcggagtaggaaaccgggacttcgtggaaggcctgagtggagcgacatgggtggacgtggtgctggaacacggagggtgcgtgacaacaatggcgaaaaacagaccgaccctagacatcgaactacagaaaacagaagcgacacaactcgcaaccctgcggaaactgtgcatcgaaggaaaaataaccaacataaccactgacagcagatgccccacgcaaggagaagctgtcctcccggaagaacaagatcaaaactacgtctgcaaacacacctatgtggataggggatggggaaacggctgcggattgtttgggaaagggagtttagtaacctgcgcgaaattccagtgccttgaacccatcgaaggaaaagtcgtccagtacgaaaacctaaaatacaccgttataataaccgtgcacacaggcgaccaacaccaggttggaaacgacactcaaggggtcaccgtggaaatcacgccacaagctagcacagtggaggcggtactcccggaatatggcaccctcggactcgaatgctcaccccgaacagggctagactttaacgaaatgatcctactcacgatgaaaaacaaagcgtggatggtccaccgacaatggttcttcgacctaccactaccctggacatcgggggctacaacggagacccccacctggaaccgtaaagaactcctcgttactttcaaaaacgcccacgcgaagaaacaagaggtcgttgtacttggctcccaggaaggggccatgcacaccgcgctaaccggagcaacagaaatccagaactcgggaggcacaagcatattcgcggggcacctgaagtgcagactaaagatggacaaactcgaactgaaaggcatgtcctacgccatgtgtctcaacacattcgtactcaagaaagaagtaagcgaaacccaacatggaacgatattaattcgagtagagtacaaaggagaggacgccccctgtaagatcccattctcgacggaagatgggcagggtaaagcccacaacgggcgactcatcacggcaaatccagtggtaacgaagaaagaggagcccgtcaacatcgaggcagagccaccgttcggagaaagcaacatcgtaattggaacgggcgacaaagccttaaagatcaactggtataagaaaggatcaagtataggaaaaatgtttgaggcaaccgcaagaggcgcgcgacgcatggccattctgggcgacacggcttgggatttcggatcagtagggggagtcctaaacagcctagggaaaatggcgcatcagatcttcggctcggcatatacagcactcttcagcggggtttcatggatcatgaaaatcggcatcggcgtcctcctcacttggatcggccttaattccaagaacaccagcatgtcgttcagctgcatcgtaattggtatcatcaccctgtacctcggagcggttgtacaggccgacatgggctgtgtaataaactggaaaggaaaggaactaaagtgcggcagtggaatctttgtcacaaacgaagtccacacatggacggaacaatacaagtttcaagctgactcccccaagagattggcaaccgcaatagctggcgcttgggaaaatggcgtgtgcggaataagaagcacgacaaggatggagaacctcctctggaagcagatagcgaacgaactaaattacatattgtgggaaaacaatatcaaacttacggtcgtggttggggacatcataggggtactagaacaagggaaacgaaccttgacgccgcagcccatggagctgaagtactcatggaagacgtggggaaaagcaaagatcgtgaccgccgagatacaaaacagcagctttataatcgacggaccaaatacaccggagtgtccttctgcaagtagggcatggaacgtctgggaagtcgaggattacggtttcggcgtgtttactaccaacatatggttgaagctccgggaagtatacacacaatcctgcgaccacaggctaatgtcggcagcaataaaggatgaacgcgctgtacacgcagacatgggatactggatagagtcccagaagaacggtagctggaaactcgaaaaagcatcattcatcgaggttaaaacgtgtacatggccgaaaagccacacactctggtcaaacggcgtactggaatccgatatgattataccgaaatcactcgcaggaccgatatcgcaacacaaccaccgaccaggatatcacacccaaacagcagggccgtggcacctcgggaagctagagctagacttcaattattgcgaaggaaccacagtcgtaattacggagaactgtggaactcggggtccctcactccgaactacaacagtaagtgggaaattaattcacgaatggtgctgcagatcttgcactctgcctccattaaggtacatgggcgaagatggctgttggtacgggatggaaatccggccaattaacgaaaaggaggaaaacatggtcaagagcttagtaagcgcaggcagcggaaaagtagataactttacaatgggcgtactgtgcttagccattctcttcgaggaggtaatgagaggaaaattcggcaagaaacatatgatcgtgggtgtactgtttacattcgtgctactactatctgggcaaataacttggagagacatgacgcacactctgattatgatcggatccaacgcctcagaccggatgggaatgggtgtcacatacctagcattgatcgctacattcaaaatacagccattcctcgcgctcgggttctttctgcgcaaactcacctctcgcgagaacctactcctgggcgtcgggctcgccatggctaccaccctacaactaccggaggacatagaacagatggcaaacggcatcgccctaggactcatgaccctaaaattgatcacacagttcgaaacctatcaactctggaccgcgttagtatcattaacttgtagtaataccatattcacgctcacagtggcttggcgaaccgccaccttgatcctagctggagtgagtctgctaccgctctgccaaagtagcagtatgcggaagacagactggttaccgatgaccgtggccgcaatgggagtaccaccactgcctcttttcatatttagtctaaaggacgcgcctaagaagcgttcctggccactcaatgaaggagtaatggcagtaggtctagtaagcatcttagcatccagtctcttgcggaacgacgtccccatggcgggccccctagtagcagggggtctcctgatcgcatgttatgtcatcacaggcacctccgcagacctcacagtagagaaggcggccgacgtgacctgggaagaagaggcagaacagacaggggtatctcacaaccttatgatcaccgttgacgatgacggtacgatgcgcatcaaggacgacgaaaccgaaaacatacttacggtcctactaaagacagcactactaatagtctcaggcatattcccgtacagcatccccgctacgctcctggtatggcacacgtggcaaaaacagacacaaaggagcggggtactctgggacgtccctagcccacccgagacccaaaaagcagaactggaagagggggtatatcggataaaacaacaaggaatcttcggaaaaacgcaagtaggggtcggagtgcaaaaagagggtgtcttccatactatgtggcacgtaacaaggggtgctgtactgacccacaacgggaagcgactagagcctaattgggcatccgtcaagaaggacttaatctcctacgggggaggatggaggcttagcgcacaatggcaaaaaggcgaagaggtacaggtaatagcagtcgaaccaggcaagaaccctaaaaatttccaaacaatgccggggatatttcagacaacaacaggagaaattggagccatagccctcgacttcaaaccaggcacaagtggctcccccataattaaccgtgagggaaaagtggtgggtctatacggcaacggtgtagttaccaaaaatggaggttacgtctcaggcatcgcacaaacaaacgccgaaccggacgggccaaccccggaactcgaggaagagatgttcaaaaagagaaacctaaccatcatggacctacaccccgggtctggtaagacacgaaaatacctgccagcaatagtgagggaggcgataaagcggcgactgcgcacactgatactggcaccaaccagagtcgtagcggctgagatggaagaagcactaaaaggtctacccatcagataccaaacgacagcgaccaaaagtgaacacactggccgtgaaatagtcgaccttatgtgccacgcaacgttcaccatgcggctactaagcccagtaagagtcccaaactacaatctaatcataatggacgaggcacattttaccgatcccgcgtccatagcggccaggggctatataagcacccgcgtcgggatgggagaggcagcagccattttcatgacagccacaccaccaggcaccgccgaagcctttccacaaagcaacgcgccaatacaggacgaggaaagagacataccagaacgctcatggaacagtggtaacgaatggattactgactttgtggggaagacggtgtggttcgttccctcaatcaaggccggtaacgacatcgctaactgcctgcgtaagaacggaaagaaagtcatccaactgtcccgtaaaacattcgacaccgaataccagaaaacaaggcttaacgactgggacttcgtcgttacaacggacatatcagagatgggagcaaacttcaaagcggaccgcgttatcgatccacgccggtgcctaaagccggtcatcttaacagacggtccagaacgggtcatccttgcggggccaatgcccgttacagcggctagcgccgcacagcgacgaggccgtgtaggacgcaatccccagaaggaaaacgaccaatacatattcactggacaacccctgaacaacgacgaagaccacgcacactggacggaggcgaagatgctcttagacaacataaacaccccggaaggaatcataccggctctgtttgagcccgaaagagagaagtccgcggccatagatggcgagtatagacttaaaggtgagtccaggaaaacttttgtcgagttaatgagacgtggcgaccttcctgtttggcttgcccataaagtcgcatcggagggcatcaaatacaccgacaggaaatggtgcttcgacggagagcggaataatcaaatcttggaggagaatatggatgtcgaaatatggacgaaagaaggcgaaaggaagaaattaaggccacgatggctagatgcacggacctactcagacccccttgcgctcaaggaatttaaagacttcgccgcaggccgtaagagtatcgcactcgacctcgtaacagagatagggcgggttcccagccacctcgcccaccgcacgcgcaacgcactggacaacctggtgatgttacacacatcggagcacggtggacgcgcgtaccggcacgcagtagaagagttgcccgagactatggaaaccctactactactcggactaatgatattactaaccggaggggcgatgctgttcttgattagcggcaagggtatagggaaaaccagcataggcctaatatgcgtaatcgttagcagcggcatgctgtggatggccgatgtaccactccaatggatcgcctcagcgatagtactcgagttcttcatgatggtgctcctaatccccgaaccagaaaaacagagaacgccgcaagacaatcagctagcctacgtagtaatcggaatcctgactctcgcagctatcgtagcagctaacgagatgggactcctggaaaccacaaagagggacctcggcatgagcaaggagccaggggcagtcagcagtacaagttacctggacgtagacttacacccagctagtgcctggaccttatatgcggtagccaccacagtcatcacgccaatgctacggcacaccatagagaacagtacggccaatgtgagcctcgctgcaattgccaatcaagcagtcgtcctaatggggctagacaaaggatggccaatcagcaagatggatctgggcgttcccttgctcgccctgggttgctactcacaagtgaaccccctaacgcttaccgctgccgtcctactacttgttacccactacgccattataggacccggcctacaggctaaagccacacgagaggcgcagaaaagaaccgctgcaggaataatgaagaacccaacagtcgacggcattatgaccatcgacctagacccagttatttacgacagtaaattcgaaaaacaactaggacaggtcatgctcctagtgctttgcgcagtacaactactattaatgagaacttcgtgggcactgtgcgaagcactaaccttagcaacaggcccgatcaccacgctctgggagggtagccctgggaaattttggaacacaacaattgcagtctcaatggctaacatctttcgggggagttacctcgcaggggccggactcgcgtttagcataatgaaaagcgtaggcacaggtcgtcgcggaaccggcagtcaaggagagacactcggggagaaatggaagaaacggctcaaccaactaagtagaaaagagttcgacctttacaaaaagtccggcataacagaagtcgatcggaccgaggcaaaggaggggttaaaacgaggggaaacaacacaccacgccgtgagccggggctctgccaagttacagtggttcgtagagcggaacatggtcataccagaaggaagagtaatcgacctaggatgcggcaggggcggctggagttattactgtgcagggctcaagaaagtaacagaggtgcgaggctataccaaaggcggtcctggacatgaagaacccgtcccaatgtcgacctatgggtggaacattgtgaagctgatgagcggaaaggacgtattctacttaccaccagaaaagtgtgacacccttctgtgcgatatcggcgagtccagtccatcacccacagtcgaagaatcaaggacaatccgagttctcaaaatggtggaaccatggctgaaaaacaaccaattctgcattaaggtactgaacccctacatgcccaccgttatcgagcatctagaaaggctccagcgtaaatatgggggaatgttagtaagaaaccctctaagccgaaacagtacgcacgaaatgtactggatctcaaacgggaccgggaatatagtcagcagcgtgaatatggtatcgcgacttctcttaaacaggtttacgatgacgcatcgccgacccacaatggagaaggacgtggatctaggtgcaggcaccaggcacgtgaacgccgaacccgaaactcccaacatggacgtaattggtgagcgaatcaaacgcatcaaagaagaacactccagtacctggcactacgacgacgagaatccatacaagacgtgggcataccacggtagctacgaggtgaaagcaacaggctccgcatcttcgatgataaatggcgtggtgaagttattaacaaagccctgggacgtggtaccaatggttacgcagatggccatgacagacacgacgccattcgggcagcagagggtgttcaaggagaaagtggacacacgtacaccgcgacccatgcccgggacgcgaaaagtaatggagataacggccgaatggctgtggcgcacgttgggtcgcaacaagaagccacgactctgcacgcgggaagaatttacaaagaaggtccgaaccaacgctgcgatgggggcagtgtttacagaagagaatcaatgggactctgccagggcggcagttgaggatgaggagttctggaagctcgtggatagggaacgggagctccatcgactgggcaagtgtggctcatgtgtctacaacatgatgggcaaacgagagaagaaactaggggagttcggtaaggccaagggctcccgggcaatctggtatatgtggcttggggcgagataccttgagttcgaggctttagggttcctcaacgaagatcattggttcagccgcgaaaatagctacagcggggtcgagggagaaggactacataaacttgggtacattcttagagacataagtaagatcccgggcggcgcaatgtacgcagatgacacagccgggtgggacacacgcatcacagaggatgacctccacaacgaagagaaaataacacagcaaatggacccagagcacaggcggttagcaagcgcgatattcaagctaacataccagaacaaggtagttaaagtgcaacgacccacacctaaggggacggtaatggacataatctcacgtaaagaccaaaggggcagtgggcaagtgggcacatacggacttaacaccttcaccaacatggaagcgcaactggtcagacagatggagggggagggagtgctttcgaaagccgacctggaagacccacacctattagaaaagaaaattacacagtggctcgagacgaaaggagttgagaggctgaagcgcatggcgatttcgggggacgactgcgtagtaaagccaattgacgaccggttcgcgaacgctctgctagcgctaaacgatatggggaaggtaaggaaagacataccacaatggcaaccatcaaaaggctggcacgactggcaacaagtacccttctgtagtcaccactttcacgaattgatcatgaaggacggccggaagctagtcgtaccctgccgcccgcaagacgaactcataggtcgggcacgcatctcccaaggtgccggatggtcgctgaaggagacagcatgccttggcaaggcttacgctcaaatgtggtccctaatgtacttccatcgacgtgacctcagactagcaagtaacgccatatgcagtgcagtacctgttcactgggttcccacaagtcgcacaacctggtccatccacgcacaccaccaatggatgaccactgaggacatgctcaccgtctggaaccgagtttggatagaggacaatccatggatggaggataagactccagtcaccacgtgggaggacgtaccgtacttaggaaagcgggaggatcaatggtgtggctcactaataggactaacatcgcgtgcaacatgggcgcaaaacatactcaccgccatccaacaagttcgatccctaataggggacgaggagtttttagactatatgccatcgatgaaacgtttcagaaaggaagaggaatccgagggcgcgatctggtag

SEQ ID NO: 26192 - RNA, 9873 nt, synthetic construct
  misc_feature 1..9873: note = derived and/or modified CDS sequence (opt11) from DENV-3__JN662391__SS-prME
  source 1..9873: mol_type = other RNA
acgagcctttgcttaatgatgattctacccgccgctctggcgttccacctcacctctcgggacggcgagccccggatgatcgtaggaaagaacgagcgcgggaagagcctgttgttcaagaccgcgtccggtattaacatgtgcaccctcatcgccatggacctgggcgagatgtgcgacgacaccgtgacctataagtgcccgcatatcaccgaggtggagcccgaggacatcgactgttggtgcaatctgacaagcacctgggtgacctacgggacctgcaaccaggcaggcgaacatcggcgcgataagcggtccgttgccctcgccccccacgtgggcatggggctggacacccgcacccagacctggatgagcgccgagggcgcctggcggcaggttgaaaaggtggagacgtgggctctgcgacatcctgggttcaccatcctcgcgttgtttctggcccactacatcggcacctccctaacccagaaagttgttatcttcatcctgctgatgctcgttactcccagcatgacgatgcggtgcgtcggggtgggaaaccgcgacttcgtggagggcctgtccggggccacctgggtggacgtggtcctggaacatggcgggtgcgtgaccacgatggccaagaacaagcccacactcgacatcgagttgcagaagacagaggccacccagttagcgacgcttcggaagctgtgtatcgaaggcaagatcaccaacataaccaccgattcgcgatgccccactcagggcgaggccgtgctccctgaggagcaagaccagaactacgtctgtaagcacacctatgtagaccgggggtggggtaacgggtgcggcctcttcgggaagggctcactggtgacttgcgctaagtttcagtgcctggagcccatcgaggggaaggtcgtacaatacgagaacctcaaatacaccgtgatcatcacagtccacaccggggaccaacaccaggtggggaacgagacccagggggtcaccgccgagatcacgccccaggccagcacaacggaggcgatcctgcccgagtacggcaccctggggcttgagtgctccccgcgcacaggcttagacttcaacgagatgatcctgctcacgatgaagaacaaggcctggatggtgcaccggcaatggttcttcgacctgcccctgccctggaccagcggcgctaccaccgagacgccaacctggaaccgcaaagagctcttagtgacctttaagaacgcccacgccaagaaacaggaggtggtggtgctggggtcccaggagggcgcgatgcacaccgcgctcacgggggccaccgagatccaaaactcaggagggacttccatcttcgccggccacctgaaatgccggctgaagatggacaagctcgaactaaagggcatgtcgtacgccatgtgcaccaacacgttcgtcctgaaaaaggaggtgtccgagacccagcacggcaccatcctcatcaaagtggaatacaagggcgaggacgcgccgtgcaagattcccttttccaccgaagacgaacaggggaaggcccacaacggccgcctgatcacggccaaccccgtcgtgaccaagaaagaagagcccgtgaacatcgaggcagaaccccccttcggcgagagcaacatcgtgatcgggatcggcgacaacgccctgaagatcaactggtacaagaagggatcctctatcggcaagatgtttgaagccaccgcccgcggggcccggcggatggcaatcctgggtgacacagcgtgggacttcggttccgtcgggggcgtactcaattcactgggcaagatggtgcaccagatattcggctccgcctacacggccttattcagcggagtgtcctgggtgatgaagatcggcatcggagtgctcctgacctggataggcctgaacagcaagaacacctccatgagcttctcctgcatcgccattggcataattacgctttacctgggggccgtggtgcaagcggacatgggctgcgtcatcaactggaagggcaaggaactgaagtgtggcagcggcatcttcgtgacgaacgaagtgcacacttggaccgagcagtacaagttccaggccgactctcccaagcgtctcgctaccgccatcgccggggcgtgggagaacggcgtctgtgggatccgcagtaccaccaggatggagaatctgttatggaagcagatcgcaaacgagctcaactatatcctgtgggagaacaacatcaagctcaccgtggttgtcggcgacacaatcggggtactcgagcaaggcaagcgcaccctgacgccccagccaatggaactgaagtactcctggaagacctggggcaaggccaagatcgtgaccgcagagacgcagaacagctcgttcatcatcgacgggccgaacacccccgagtgccctagcgcgagtcgggcctggaacgtctgggaggtggaagactacggcttcggagtgttcacaaccaacatctggctcaagctgcgggaggtctatacccaaatgtgcgaccaccggctgatgtcagccgctgtaaaggatgagcgcgccgttcatgcggatatgggctactggatcgagtctcagaagaacgggagttggaagctcgagaaggcctcgctgatcgaggtcaagacttgcacctggccgaagtcccacaccctgtggagcaatggcgtgctcgagtccgacatgatcatccccaagagccttgccggccccatatcccagcacaattaccggccaggatatcatacccagacggccggcccctggcacctggggaagctcgagttagacttcaactactgcgagggcacaaccgtagtcatcaccgagaactgcggcacgcgcggccccagcctgagaactaccaccgtgtccggcaagctcatacatgagtggtgctgccgcagctgcacgttgcccccgctgcggtacatgggtgaggatggctgctggtacgggatggagatccgccctatttccgaaaaggaggagaacatggtcaagagcttggtctccgccggcagcggcaaggtggacaacttcacaatgggcgtgctgtgcctggcgatcctcttcgaagaagtcatgcggggcaagtttgggaagaagcacatgatcgccggcgtgttcctgacctttatgctgcttctgtctgggcagatcacctggcgcgacatggcccacacgctgatcatgatcggcagcaacgcctccgaccggatgggtatgggggttacgtacttggccctcatcgctacctttaagatccagcctttcttggccctcggcttcttcctacggaagctgactagcagagagaacctcctgctaggggtaggcctcgccatggccacgaccatccaactgccagaggacatcgagcagatggcgaatggcatagcgttagggctaatggccctgaagcttattacccaatttgagacctaccagctctggacggcgctaatcagcctgacttgctccaacaccatcttcaccctcaccgtagcctggcgcacagcaacactgatcctggccggcgtgagcctcctgcccgtatgccagtccagcagtatgcggaagaccgattggctgcccatgacggtggccgccatgggggtgcctcccctcccgctgttcatcttcagcttaaaggataccctcaagaggcgctcctggccgttaaacgagggcgtgatggccgtggggctggtcagcatccttgcctccagcctgctgcggaatgacgtgcccatggccggccccctcgtggcgggcgggctgctgatcgcctgctacgtcataacggggacctcggcggatctcacggtggagaaggcggccgacgtaacctgggaggaggaggccgagcagaccggcgtgtcacacaacctgatgataacagtggacgacgacggcactatgcgcatcaaggacgacgagactgagaacatcctcacagtgctgctgaaaactgccctgctcatcgtttccgggatcttcccgtactctattcccgccaccctcctggtgtggcacacgtggcaaaagcagactcaacggtctggcgtgctatgggacgtcccctcaccgcccgaaacacagaaggcagagctggaggagggcgtgtaccgaataaagcagcagggtattctgggcaaaacgcaagtgggggtcggcgtacagaaggagggggtcttccacacgatgtggcacgtcacgcggggcgccgtgctcacccacaatggcaagcgcctagagcctaactgggcctccgtcaagaaggacctgatttcctacgggggcgggtggcggctctccgcccaatggcaaaagggagaggaggtccaggtaattgctgtggagcccgggaaaaacccgaaaaacttccagacgatgcccggaacgtttcaaaccaccaccggtgagatcggggctattgccctggacttcaagcccggcacgagcggaagccccattatcaaccgcgagggtaaagtcgtggggttatacgggaacggcgtggtcaccaagaatgggggttacgtgtccgggatcgcccagaccaacgccgagccggacggccccactcccgaactggaggaggagatgttcaagaagcggaacctcacgatcatggacttacaccccggcagcgggaagacccgcaagtacttacccgcgatagtgcgggaggccatcaaacgtcggctccgcaccttgatcttggcccccacccgtgtcgtagccgccgagatggaggaggcgctcaagggcctgcccatcagataccagacgaccgccactaagtccgagcacaccgggcgggagatcgtagacttgatgtgtcatgccacgttcaccatgcgcctcttgtcacccgtccgtgtgccgaactacaatttaatcatcatggacgaggcccacttcaccgaccccgcctccatcgccgcccgcggctacatcagcacccgggtggggatgggcgaggccgccgcgatcttcatgacagccactccgcccggcactgccgacgccttcccgcagagtaacgccccaatccaggacgaggagagggacatccccgagcgcagctggaactccgggaacgagtggatcaccgacttcgcgggcaagacggtctggttcgtgccatcgatcaaggcagggaacgacatagccaactgtctccgaaagaacggcaagaaagtgatccagctgtcccgcaagaccttcgacaccgaataccagaagaccaagttgaacgactgggatttcgttgtgacgactgacatctctgaaatgggcgccaacttcaaagctgaccgggtgatcgacccccgccggtgcctcaagcccgtcatactgaccgacggtcccgagcgtgtgatcctagcgggccccatgcccgtgacggtcgccagcgccgcccagcggcgcggacgtgtgggtcgcaacccccagaaggagaatgaccagtacattttcaccgggcaacccctcaacaacgacgaggaccacgcacactggacggaagcgaagatgctgctggacaacatcaacacccccgagggcatcatcccggcgctcttcgagcccgagagagagaagtccgccgccatcgacggagagtaccgactgaagggcgagtctcggaagaccttcgtggagctgatgcgacggggcgacctccccgtctggttagcgcacaaggtggcctcagaggggatcaagtacaccgaccgcaaatggtgcttcgacggccagcggaacaaccaaatcctggaggaaaacatggacgtcgagatctggacaaaagaaggggagaagaagaagctcaggccccggtggctggacgccaggacgtactccgacccgcttgccctcaaagaattcaaggacttcgccgcgggccgcaaaagcatcgccctggacctggtgacggaaatcggccgggtgccgtcccacctagcgcaccgcacccggaacgcactggacaacctagttatgctccacacgagcgagcacgggggccgggcctacagacatgcagtagaggaacttcccgagaccatggagaccctgctcctgcttgggctgatgatccttctgaccggcggggccatgctattcctgatcagcggcaagggcatcgggaagacctcaatcggcctaatatgcgttatcgccagctccgggatgctctggatggccgagattccgttgcagtggatcgcaagcgctatcgtactggagttctttatgatggtgctcctgatccccgagcccgagaaacagcgcacgccccaggacaaccaactggcctacgtggtcatcggcatactcactctggcggcgattatcgccgcgaacgagatggggttgctagagaccacgaagcgggaccttggcatgtcaaaggagccgggcgtggtgagccccacctcatacctggacgtcgacctacatcccgccagcgcctggaccctgtacgcagtcgcgacgacggtgatcacacccatgctacgccacaccatcgagaactccaccgctaacgtcagtctcgctgccatcgccaaccaggcggtggttctgatggggcttgacaaaggctggccgatttccaagatggatctcggggtcccccttctcgccctcgggtgttactcacaggtgaaccccctgacactgactgcagccgttctcctgttagttacccactatgccatcatcgggcccggtctgcaggcaaaggccacccgggaggcccagaagcgcacggcagcgggcatcatgaagaacccgaccgtggacgggatcatcaccatcgacctggaccccgtgatctatgactccaaattcgagaagcagctggggcaagtcatgctattggtgctgtgtgcggtgcagctcctgctgatgcggacgagctgggcgctctgcgaggccttaacactcgcgaccgggcccataaccaccctctgggagggctcccccggcaagttttggaacacgaccatcgcggtcagcatggcgaacatcttccgcgggtcctacctggccggcgccgggctggccttcagcataatgaaatccgttggaactgggaagcggggcaccggctcacagggggagaccctcggagagaagtggaagaagaaactgaatcagctgtcgcgcaaagagttcgacctctacaagaagtccgggatcacggaggtagatcgcaccgaggccaaggagggcctgaagaggggggagaccacccaccacgccgtcagccggggctccgctaagctgcagtggttcgtggagcgtaacatggtgataccagagggtcgtgtcatcgacctcgggtgcggccgcgggggctggagctactactgtgccgggctgaagaaggtaacggaggtgcggggctacaccaagggggggccgggccacgaggagcctgtccccatgtcaacccacgggtggaacatcgtgaagttaatgagcggcaaggacgttttttatctcccgcccgaaaagtgcgacaccttactgtgcgacataggggagtccagcccctccccgacggtcgaagagtctcgcacgatccgcgtgctgaagatggtggaaccgtggctcaagaacaaccagttttgcatcaaggtactgaacccctacatgcccgccgttatcgaacacctggagcggctacaacgcaagcacggcggcatgcttgtacggaatcccctgtcccgcaactcgacgcacgagatgtactggatctccaacgggaccggcaacatcgtctcatccgtcaacatggtgtcacgtctcctgctgaaccgcttcacgatgacccatcgccgcccgaccatcgagaaggacgtggacctcggggctggcacccggcacgtgaacgcggagcccgaaactcccaacatggacgttatcggcgagcggatccggcggatcaaggaggagcataactcaacctggcactacgacgacgaaaacccgtacaagacctgggcctaccacgggtcatacgaggtcaaggccacaggctccgccagctccatgatcaacggagtggtcaagctgctgacgaagccctgggacgtggtgccgatggtcacccagatggcgatgaccgacaccacgcctttcggccagcagcgggtgttcaaggagaaggtcgacacccgcaccccaagacccatgccggggacccgcaaggtcatggagatcacggccgaatggctatggcggaccctgggtcgcaacaagcgtccccgcctgtgtacccgcgaggagttcaccaagaaggtcagaaccaacgccgccatgggcgcggtcttcaccgaggagaaccagtgggactcagccaaggccgccgtcgaggacgaggagttctggaagctggtggaccgcgagcgggagctgcacaagctggggaagtgtggcagctgcgtgtacaacatgatggggaagagagagaagaaattaggggagttcgggaaggccaaaggctcccgggcgatctggtacatgtggctgggagcacgatacctggagttcgaggcactcgggttcctgaacgaggaccactggttcagccgggagaactcctactcaggcgtagagggggagggccttcacaagctcggttacatcctgcgcgacatctccaagatcccgggcggcgcaatgtacgcagacgacaccgcggggtgggacaccaggattacggaggacgacctgcacaacgaggagaagatcacccagcagatgaacccggaacatcgcctcctggctaacgccatattcaaattaacctatcaaaacaaggtggtgaaggtccagcggcccacccccaccggaacggttatggacatcatcagcaggaaagaccagcgcgggtccggccaggtgggcacctacgggctcaacaccttcaccaacatggaggcgcagctggtacgccagatggagggcgagggggtgctgagtaaggccgatctcgagaatccgcacctcccagagaagaagataacgcagtggctggagaccaagggcgtggagcggctcaaacgcatggcgatttccggggacgattgcgtcgtaaagcccatagacgaccggtttgccaatgccctgctggccctcaacgatatgggaaaggtgcgtaaggatataccccagtggcaaccatccaaaggctggcacgactggcagcaggtccctttctgctcccaccactttcacgagctgatcatgaaggacggtaggaagctagtggtgccctgccgcccgcaggatgagctcatcggccgggcccgcatcagtcaaggggcgggttggtccctgcgcgagaccgcctgcctggggaaggcctacgcccagatgtggtcgctcatgtacttccaccggcgcgacctgcggctggcctccaatgccatctgtagcgccgtcccggttcactgggtacccacctcccgcaccacatggagcattcacgctcaccaccagtggatgaccaccgaggacatgctcaccgtatggaatcgtgtgtggatcgaggacaacccctggatggaggacaaaacgcccgtgaccacctgggagaacgtcccatacctgggcaagcgagaagaccagtggtgcggaagcctgatcgggctgaccagtcgggccacctgggcgcagaacatctcgaccgccatccaacaggtccgcagtctgatcgggaacgaggagttcctggactacatgcccagcatgaagcggttccgcaaggaggaggagtcagagggggccatatggtga

SEQ ID NO: 26193 - RNA, 9873 nt, synthetic construct
  misc_feature 1..9873: note = derived and/or modified CDS sequence (opt11) from DENV-3__AY858043__SS-prME
  source 1..9873: mol_type = other RNA
acctcactatgcctaatgatgatgctaccagctaccctggcgttccacctaacatcgagggacggtgaaccgcgcatgatagtaggtaaaaatgaacgcggtaaatcactactgttcaaaacagcctcaggcatcaacatgtgcacacttatagccatggatctgggcgaaatgtgcgatgacacggtaacgtataagtgccccctaatcacggaagttgaaccggaagacatagactgctggtgcaacctaacgagcacctgggtcacttatggtacatgcaaccaggctggtgaacaccgacgagacaaacggtccgtcgcactcgcgccgcatgtcggtatggggctcgacacccgagcacaaacgtggatgtccgcagaaggcgcgtggcgacaagccgagaaagtggaaacctgggcactacggcatccaggcttcaccatcctcgcactattcctggcccactatatagggacctcgctaacacagaaggtcgtaatcttcatactcctgatgctagtaacgcccagcatgacaatgcgctgcgttggagtggggaaccgagacttcgtcgaaggcctgtctggagcaacctgggtagacgtcgtattagaacatggtgggtgtgtcaccaccatggcgaaaaacaagccaaccctagatatagagctgcagaagaccgaggcgacccaactagcaacactccgcaaactatgtatagaaggcaagataaccaatgtcacgacagattcaaggtgcccaacccaaggtgaagcgatattacccgaagaacaagaccaaaactacgtgtgcaggcacacctacgtcgaccgaggctggggcaacggttgcggactcttcgggaaaggtagcttagtaacatgcgcaaaattccaatgccttgagctcatagagggcaaagtagtccaacacgagaacctaaaatatacagtgataattacagtccacaccggggatcagcaccaggtaggaaatgaaacccaaggggtaaccgcggagataacaccccaggcgtcgaccgtagaggcgatactaccggaatacgggacattgggactagagtgcagcccaagaacgggactggactttaacgaaatgattctattaaccatgaaaaacaaagcgtggatggtgcataggcagtggttctttgatctgccgcttccctggacaagcggggccacgaccgaaacaccaacatggaacaagaaagaactcctagtcacctttaaaaacgcccacgccaagaaacaagaagttgtagttttgggctctcaggagggcgctatgcacacagccctaaccggcgctacagaaatacagaccagtggcggcacctccatattcgcgggacacttgaaatgcagacttaagatggacaagctagaactgaaggggatgtcttacgccatgtgcagcaacgcattcgtgctcaagaaagaagtcagcgaaacgcagcatggaacaatcttgataaaagtcgaatataaaggcgaagacgcaccctgtaaaattccattctcaactgaagacgggcaaggcaaagtccacaacggtcgcctgataaccgcaaacccggtagtaacaaagaaggaggaaccggtgaatatagaagcggagccaccctttggagaaagcaacattataatcggaattggcgacaaggccctaaagataaattggtataagaaagggagttccattggaaaaatgttcgaggcgaccgcgcgaggagcaagaaggatggcgatactgggagacactgcatgggacttcggcagcgtcggcggtgtgctaaacagcctaggcaaaatggtccatcagatctttggttcagcatacacagcattgtttagcggggttagctggatcatgaaaataggaatcggagtgctgttgacttggatagggctgaactccaaaaatacctcaatgtcattttcctgtatagtcatcggaatcattacactataccttggagcggtcgtccaagcagacatgggttgcgtaattaattggaagggcaaggagctcaagtgcgggagcgggatttttgtgaccaacgaggtccatacatggacagaacagtacaaattccaggctgactctccgaagaggcttgcgacagcaattgcaggggcctgggagaatggtgtgtgcggaatacggagtacgactcgcatggagaacctactatggaaacagatcgctaacgaattgaactacatactatgggagaacaacataaagctcacagtcgtagtaggcgacatcataggagtactagagcaagggaaaagaacgctaaccccacagcccatggaattaaagtacagctggaaaacctggggaaaagctaaagttgttactgcagaaattcaaaattcatcgttcataatagacgggccgaacactcccgaatgccccaacgcgtcgcgagcctggaacgtttgggaggtcgaagactatggatttggagtcttcacaacgaacatatggctcaaacttcgcgagatgtacacccaactctgtgaccacaggctaatgtcggcggcagtgaaggacgagagggcggtacacgccgacatgggctactggatagagtcgcaaaagaacggctcatggaaactggagaaggcaagccttatagaagttaagacttgtacgtggcccaagtcccacaccctctggtcgaacggagtcttagagtccgacatgatcatcccgaaatcattggcgggacccatatcacagcataattatcgtcccgggtaccatacgcaaacggccggcccatggcacttgggaaaactcgagctagacttcaactattgcgaggggacaaccgtggtgatcacagagaactgcgggacccgaggcccctcgttgcgtacaacgaccgtctccggaaagctaatccacgaatggtgctgccgatcttgcacactcccgccactccgttacatgggggaggacggttgctggtacggaatggagatacgtcccataaacgaaaaggaagagaacatggtgaaaagcctcgtaagtgctgggtcaggcaaagtggataattttacaatgggtgtcctctgtctagccatcctatttgaggaggttatgcgaggaaagtttggtaaaaagcacatgatcgccggcgtgctttttatgttcgtcctactgctcagcggacaaataacgtggcgggacatggcccggacactcatcatgatagggtccaatgcatccgacagaatgggcatgggagtgacctacctggccttaatagccacgtttaagatacagccatttcttgccctcggattctttctccggaagctcacctcgagagaaaacctactcctaggagtcgggctggccatggccacgaccctgcagctacccgaagacatcgaacaaatggccaacggtatcgcactagggctgatggcccttaagctcataacccaattcgagacctaccagctgtggacggctctcgtttccctaacctgttccaatactattttcacgctaacagtggcttggagaacggcgacactgatcctcgcagggatctcgttgctaccagtctgtcaatcgtcctccatgagaaaaacagattggctccctatgactgtggccgccatgggagtaccgccgcttcctctcttcatattcagcctaaaagacacgctcaagaggcgctcgtggcccctgaacgagggtgtgatggcggtcggcctagtctccattctcgcatcctcgctgctgcgtaacgacgtacccatggcaggtccccttgtcgctggaggcctgctaatagcgtgctacgtcatcacaggcacgagcgcagacttaactgtcgaaaaggcggcggacgttacgtgggaggaagaggcagagcaaactggcgtcagccacaacctgatgataactgtcgacgatgatggaacaatgcgcatcaaggacgatgagacggaaaacattttaactgtcctcttgaagactgcactgctcattgtgtcaggcatattcccctacagtatacctgcgaccctcctagtgtggcacacatggcagaagcagacccaacggtcgggtgtactatgggatgtgccgtcccctcccgaaactcaaaaagcagaactagaggaaggcgtctaccgcatcaaacaacaaggcattttcgggaaaacacaggtaggtgtaggagtccagaaagaaggggtgtttcacaccatgtggcatgtaacacgaggcgctgtcttgacatacaacggcaaaagattagagccaaattgggccagcgtgaaaaaggatctcatcagttacgggggagggtggcgcctctcagcacaatggcggaaaggcgaagaagtgcaagtaatagccgtcgaacccggcaaaaacccaaagaacttccagacgatgccgggcatctttcagacgaccacgggtgagatcggggccatagcacttgacttcaaaccaggaacgtcaggaagccccatcatcaaccgggagggcaaagtggtgggactgtatggaaacggagtcgtcacgaagaacggcggttacgtatcagggattgcacaaacaaacgcagaaccggacggaccgacaccagaactggaagaggagatgttcaagaagagaaacttgacaattatggatcttcacccaggtagcggtaaaacccgaaaatatctgccggccatcgtgagggaagcgatcaaaagacggctacgcacactgatactcgcaccaaccagagttgtggccgccgagatggaagaagcactgaaaggcctaccaatccgatatcagacaacagcaactaagtccgaacacacgggaaaggaaattgtggacctaatgtgccacgccaccttcacaatgaggctcctgtcccccgtccgcgtgcctaattacaacctaataatcatggacgaggcgcacttcacagacccagcaagcatagccgcaagaggatacatatcaacgagagtaggaatgggggaagcagcagcaatatttatgaccgcgacgcccccaggtactgccgatgccttcccccaatcaaacgctccaatacaagacgaggagagggacatacccgaaagatcctggaatagcggcaacgactggatcactgacttcgcagggaaaaccgtgtggtttgtaccctccataaaagcaggtaacgacatagctaattgcttgaggaaaaatggaaagaaagtaatacaattaagtagaaagacttttgacacagaataccagaaaacaaagctaaatgactgggacttcgtcgtaaccaccgatatctccgaaatgggggcaaatttcaaagccgatcgggtcatagacccgcgccgctgtctcaaaccagtaatactcaccgacggcccagaaagagtcatccttgctggacctatgccagtgacagtagcgagcgctgcgcaacggcgtgggagggttggacgcaacccgcagaaggagaacgatcagtacatattcacaggacaacccctgaacaacgatgaagaccacgcacactggacggaagctaagatgctgctagacaacataaatactccggaaggaataattcccgctctattcgagcccgagagagaaaaatccgcagccatcgacggggaatatcgcctcaaaggagaaagtcggaagacgtttgtagaattaatgcgaaggggagacctcccggtgtggctagcccacaaagtggcctctgaaggaattaaatacacggaccgcaagtggtgcttcgatggcgaacgaaacaaccaaatactagaggaaaacatggatgttgaaatctggaccaaagaaggggagaaaaagaagttacgaccgcgatggctcgacgccaggacctactcagacccactagctctaaaggagttcaaagactttgccgccggccggaaaagcattgcactcgacttagtgacagagatagggcgagtaccctcacacctagcccaccgtacaagaaacgcactggacaacctagtaatgctacacacatcggaacacggtgggagagcataccgtcacgcggtagaagaactaccggagacgatggaaacctttttgctgctaggcctcatgatcctcttgacgggcggggcgatgctgttcctcatctccgggaagggagtggggaaaaccagcatagggctaatatgtgtagtggccagcagcggcatgctgtggatggccgacatccccctgcagtggatcgcttccgccatagtactcgaatttttcatgatggtcctactcatcccagaaccggaaaagcagcgtacacctcaggataaccaactggcatacgtagtcattggcattttgacactcgctgccatagtggcggccaacgaaatgggtctgttagaaaccacgaaaagagacctggggatgtctaaagaacccggtgtagtttccccaacttcatacctagatgtagatctgcacccagcgagcgcgtggacgctctacgcagttgctactacagtcattacaccaatgctcagacacacgatagagaactccaccgcgaacgtgagcctggcggccattgcaaaccaggcggtagtcctgatggggctagacaagggctggccgattagcaagatggaccttggggtacccctactcgccctagggtgttactcgcaagtgaaccccctcaccctaacggccgctgtcctgctcctggtcacacactacgccataataggcccgggcttgcaagcaaaagcgacgcgagaggcgcagaagcgcactgccgcaggaattatgaagaacccaacggtggacggtatcatgaccatagacctcgatccagtcatttacgactctaagtttgaaaaacagctcggtcaggtaatgctgctagtactgtgcgcagtccagttactcctcatgcgaacgtcctgggccttctgcgaagccctaaccttagcaaccggacccatcaccactctgtgggaggggtctccaggcaagttctggaacaccactatagccgtctccatggctaacatcttccggggtagctacctagcaggggccggcttggccttttccatcatgaaaagcgtgggaactgggaagagaggaaccgggagccaaggagaaaccctcggagaaaagtggaaaaagaaattgaaccaactatcccggaaagagttcgacctttacaagaaatccggcatcacagaggtagaccggacggaagcgaaagagggtctcaaaagaggggaaacgacacaccatgccgtaagcagaggcagcgcgaaattgcaatggttcgtggaacgcaacatggtaatcccggaagggagggtaatagacctgggatgcggaagagggggctggtcgtactactgcgcgggtctcaagaaagtaacagaggtgagaggttacaccaagggcggccccggtcacgaggagccggtacccatgtcaacatacgggtggaacatagtcaagctgatgtcaggcaaagacgtattctacctcccacccgaaaagtgcgacacactactatgcgacataggagagtcgtcgccatcacccactgtggaagaatccagaacgatacgcgtactaaagatggttgaaccatggctcaaaaacaaccagttttgcataaaagtactaaatccctacatgcctacagtaatagaacacctagagagactacaacgaaaacacggaggcatgctggtacggaaccctttgagcagaaacagtacccacgaaatgtactggatatcaaatggcaccggaaatatagtttcaagcgtgaacatggtatcccgactactcctgaaccggtttacaatgacgtacaggcgacctactatcgaaaaggacgtcgaccttggagcgggaacccgacacgtgaacgcggaaccagaaacaccaaacatggacgtaatcggagagagaataaggagaatcaaggaggagcacagttctacttggcactatgacgacgaaaacccctataagacatgggcatatcacggatcttacgaagtcaaggccactggatccgcctcaagcatgattaacggggttgtgaaattactaacaaagccgtgggacgtcgtgccgacagtaacccagatggccatgacagacacgacgccattcggacagcagcgtgtctttaaggaaaaggtcgacacccggaccccaaaaccgatgcctggcacccgcaaagtcatggagatcacagcggagtggctatggcgcaccctgggtagaaacaaaaggccgcggctttgcacacgagaagagttcacgaagaaagtaaggacaaatgcagcaatgggggccgttttcaccgaagagaaccaatgggacagcgcaagagcagcagtcgaggacgaagagttctggaagttagtagacagagaacgagaactgcacaaacaaggtaagtgcgggtcctgcgtatacaacatgatgggaaagcgggaaaagaaacttggcgaatttggaaaagccaaggggagccgagctatttggtatatgtggcttggagcacggtacctggagttcgaagctctaggattcctcaacgaagaccactggtttagccgtgaaaatagttacagcggagtagaaggcgaggggcttcacaaacttggatacatactgcgcgacattagcaaaataccaggaggagccatgtacgctgacgacacggccgggtgggatacgcgcattaccgaagacgatctacataacgaggagaagattacacagcagatggacccggagcacaggcagctcgctaatgcgatcttcaagctgacatatcaaaacaaagttgtgaaagtgcaaaggcccacgccaaaaggcacagtcatggacatcatcagtagaaaagaccaaagaggatccggacaggtgggcacgtacggactcaacacctttaccaacatggaagcccaactgataagacagatggagggagaaggagtactgtccaagaccgacttagaaaacccacacctcctcgagaagaaaatcatccaatggctggaaacgaaaggcgtcgaacgattaaagcgaatggcgatctcgggcgacgactgcgtcgtaaaacccattgacgacagattcgcaaacgcgcttctagcactcaacgatatgggaaaagtgcgaaaagacatcccgcaatggcaaccaagcaggggttggcacgactggcagcaggtccccttctgcagccaccacttccacgagctgattatgaaggatgggcgtaaactcgtagtcccatgtcgaccccaagacgagcttatcggccgcgcccgcataagccagggagcagggtggtcactcaaagagacagcctgcctgggaaaggcgtacgcccaaatgtgggcgctaatgtacttccacaggagggacttacgactcgcttcaaacgctatttgcagcgccgtgcctgtgcactgggtccccacaagtagaaccacctggagcatacacgcacaccaccaatggatgaccacagaggatatgctaacagtctggaatagagtttggatagaggacaacccttggatggaagacaaaacgcctgtgacaacctgggaggacgtaccctatctagggaaaagggaagatcagtggtgcggcagcctaatcggcctgaccagccgagctacctgggcacagaacatccttaccgcgatacaacaagtgaggtctctcatcggaaacgaagagttcctagactacatgccatccatgaaacgtttccgaaaagaagaagaatcggagggagcaatatggtaa

SEQ ID NO: 26194 - RNA, 9873 nt, synthetic construct
  misc_feature 1..9873: note = derived and/or modified CDS sequence (opt11) from DENV-3__AY858044__SS-prME
  source 1..9873: mol_type = other RNA
acaagtctgtgcctcatgatgatgctgcccgccaccctggctttccacttaacctcaagagacggggagcccagaatgatcgtggggaagaacgagcgcggcaagagcctgctgttcaaaacagcgtccggaatcaatatgtgtacgctcatagccatggaccttggggaaatgtgcgacgacaccattacctacaagtgccccctgatcaccgaggtggagcccgaggacatagactgttggtgcaacctgacctctacttgggtgacgtacgggacctgcaaccaagcgggcgagcaccggagagataagcggagcgtggccctggcgccccacgtggggatggggctggacacccgcgcgcagacgtggatgagcgcggagggcgcgtggcgccaggtggaaaaggtggagacgtgggccttccgccaccccggattcaccatccttgcgctgttcctggcccactacatcggcacctccctgactcagaaagtggtgatcttcatcctgctgatgctcgtgacgccgagcatgaccatgcggtgcgtcggggtgggcaaccgcgactttgtcgagggcctgtcgggggccacctgggttgacgtggtactggagcacggcgggtgcgtcacaacgatggccaagaacaagcccacattggacatcgagcttcaaaagacagaggccacccagctggcgactctccgcaagctgtgcatcgaaggtaagataaccaatgtaaccaccgacagccgctgcccgacgcagggcgaggccatcctgcccgaggagcaggaccagaactacgtgtgcaagcacacctatgtcgaccgggggtggggcaacgggtgcggcctcttcgggaagggcagtctggttacctgcgccaagttccagtgccttgagttaatcgaaggcaaggtggtccagcacgagaacctgaagtacaccgtgatcatcacggtgcacaccggtgaccagcaccaggtcggtaacgaaacccaaggggtgaccgccgagatcactccccaagccagcaccgtcgaagcgatcctccccgagtacggcaccctcgggctggagtgcagcccgcggaccggtttagacttcaacgagatgatcctcctaaccatgaagaataaggcctggatggtgcaccggcagtggttctttgacctgccgctcccctggacgagcggcgccaccaccgagacccctacgtggaataagaaggagctgttagtgactttcaagaatgcgcacgccaaaaagcaggaggtggtagtgctcgggtcccaagagggcgcgatgcacacggccctgacaggtgcaactgaaatccagactagcgggggaacctccatcttcgcaggccacctgaagtgccgcctcaagatggacaaactggagctgaagggtatgagctacgctatgtgctccaacgcgttcgttctcaagaaagaggtcagcgagacccagcacggaacgatcctaatcaaggtcgagtacaagggagaggacgccccctgcaagatcccgttcagcacagaggacggacagggcaaggcccacaacggcagactgataaccgctaaccccgtcgttaccaaaaaggaggaaccggtaaacatcgaggcggaacccccgttcggcgagtccaacatcatcatcggcatcggggacaaggccctaaaaatcaactggtacaagaagggcagctccatcgggaagatgttcgaggccacggcccgcggcgcccggcgcatggcgatcctcggggacacggcctgggacttcggaagcgtcggcggcgtgctaaattccctgggcaagatggtgcaccagatcttcgggagcgcctacaccgccttattctcaggcgtcagctggatcatgaagatcgggatcggggtattgttgacctggatagggctcaactccaagaacacgagcatgtccttctcttgcatcgtgatagggattatcaccctgtacctaggcgcagtcgtgcaggcagacatgggttgcgttatcaactggaagggcaaggagttaaaatgcggctctgggatcttcgtgaccaacgaggttcacacctggacggagcaatacaagttccaggccgacagcccgaagcggctggcaaccgccatagctggcgcgtgggagaacggggtgtgcgggatccggtccacgacaagaatggaaaacctactctggaagcagatcgccaacgagctgaattacatcctgtgggagaacaacatcaagctaacggtcgtggtgggggatatcatcggcgtcctggagcagggcaagcggaccctgacgccccaacctatggagctcaagtacagctggaagacctgggggaaagccaagatcgtgaccgccgagatccagaactccagcttcatcattgacggccccaacactcctgagtgtccaaacgcgtcaagggcctggaacgtgtgggaggtcgaggactacgggttcggagtgttcaccaccaatatctggctaaagctgcgggagatgtacacgcagctgtgcgaccaccgcctgatgagcgccgccgtaaaggacgagcgggccgtccacgcggacatgggctactggatcgaatcgcagaagaatggaagctggaagttagagaaggcctccctaatcgaggtgaagacgtgcacctggccgaagtcccacaccctgtggtctaacggcgtgctggagtccgacatgatcattcctaagtcactcgccgggccaatctcgcagcacaactaccgtccgggctaccacacccagacggccgggccgtggcacctgggcaaattggagctcgacttcaactactgcgagggcaccacagtcgtgatcaccgagaactgtgggacgagaggcccctccctgcgcaccaccaccgtatctgggaagttaatacacgagtggtgttgccggagttgcacgctcccgcctctccgctacatgggcgaggacgggtgttggtacggcatggagatacggccgatcaacgagaaggaggaaaacatggtcaagtcactggtgagcgccggctccggaaaggtggacaacttcaccatgggcgtcctctgcctggcgatcctgttcgaagaggtgatgcgcgggaagttcggcaaaaagcacatgatcgcaggggtcttattcatgtttgtcttgctgctcagcggccagataacctggagggacatggcgcgcaccctgatcatgatcgggagcaacgccagcgaccgcatggggatgggagtgacgtacctggccctcatcgcgaccttcaagatccagcccttcttggctctggggttcttcctccgcaagttgacaagccgggagaatctactcctgggcgtgggactggcgatggccactacgctccaactgccagaggacatcgagcagatggccaacgggatcgccctgggcctgatggccctgaagttgatcacccagttcgagacctaccagctctggaccgccctggtcagcctcacgtgcagcaacacaatcttcacactcaccgtggcctggcgaacggcaaccctcatcctggccggcatctccctcctacccgtgtgccagagctcctccatgcggaaaaccgactggcttccgatgaccgtcgccgccatgggagtaccgcccctcccccttttcatcttctccctgaaggacacgctcaagcgcaggagctggccgctcaacgaaggcgtgatggccgtgggcctggtttccatcctcgcaagctctctgctacgaaacgacgtcccaatggccggacccctcgtggcaggcgggctgctgatcgcgtgctacgtgatcaccgggaccagtgccgacctcactgtagagaaggcggccgacgtgacgtgggaggaggaggccgaacagaccggggtatcgcacaatctgatgatcaccgtggacgacgacggaaccatgcggatcaaggacgacgagacggagaacatcctgaccgtcctcctcaagaccgccctgctcatagtgtccggcattttcccctactccatcccggccaccctgctggtgtggcacacctggcagaagcaaacgcagcggagtggcgtgctctgggatgttcccagcccgcccgagacacagaaggcggagctcgaagagggggtctatcgaatcaagcaacaaggcatcttcggaaagacacaggtgggcgtgggggtccaaaaggagggcgtgttccataccatgtggcacgtgacgcggggcgccgtcctcacctataacgggaagcgcctcgagccgaactgggccagcgtaaagaaggacctgatctcctacggtggaggctggcggctgagcgcccagtggcaaaagggggaggaggtgcaggtcatcgcggtggagcccggcaagaacccgaaaaactttcagaccatgcccggcatcttccagaccacgactggggagatcggcgccatcgcgctggacttcaagccggggacgtccggcagccccatcatcaaccgtgagggcaaggtggtcgggctctacggcaacggggtggtcaccaaaaacggagggtacgtgagcggcatcgcccaaactaacgcggagcccgatggcccgactcccgagctggaggaggagatgttcaagaagcggaacctgaccatcatggacctccaccccgggtctggcaagacccgcaaatacctgcctgccatagtccgcgaggcaatcaaacgccggctgcgcacgctcatcttagccccgacccgggtggtcgccgccgagatggaggaggctctgaaggggctccccatccggtaccagaccactgccaccaagagcgagcacaccgggaaagagatcgtggacctgatgtgccacgccaccttcaccatgcggctgctctcccccgtgcgcgtgcccaactacaacctgatcataatggacgaggcccacttcacggacccggccagcatcgcggcccggggctacatctccacacgcgtgggcatgggcgaggcagccgcgatcttcatgaccgccacgccgcccgggacggccgacgctttcccccagagcaacgccccgatccaggacgaggagagagacatcccggagcgctcctggaatagcggcaacgactggatcaccgacttcgcggggaagacagtgtggttcgtcccctcgatcaaggccgggaacgacatcgccaactgcttgcgcaagaacggtaagaaggtgatccagctcagtcggaagaccttcgacactgagtatcagaagaccaaactgaacgactgggatttcgtagtcaccactgacatctccgagatgggcgctaacttcaaggctgaccgtgtgatagacccccgccgctgcctgaagccggtgatcctcactgacggccccgagcgcgtcatcctggcggggcccatgccggtcaccgttgccagcgccgcccagcgccgtggcagggtagggcggaacccccagaaggaaaacgaccagtacatcttcaccggccagcccctaaacaacgacgaggaccacgcccactggacagaggcgaaaatgcttctggacaacatcaacacgcccgagggtattatcccagccctgttcgaaccagagcgcgagaagtccgccgcgatcgacggtgaatatcggctcaagggcgaatctcggaagacctttgtggagttaatgcggcgcggggacctgcccgtgtggctcgcgcataaggtcgcctccgaggggatcaagtacaccgaccggaagtggtgcttcgatggggagcgcaacaaccaaattctggaggagaatatggacgtggagatctggactaaggagggcgagaagaagaaactgcgaccacgctggctagacgcccggacctacagcgaccccctggccctaaaggagttcaaggacttcgccgcgggacgcaaatccatcgctctagatctggtcacggagatcgggcgcgtgcctagccatctggcccaccggacccgtaacgccctcgacaacctggtgatgctgcacacaagtgagcacggcgggcgggcatacagacacgcggtcgaggagctacccgagaccatggagacgctgctgttattgggcttgatgatcctcttgaccgggggcgccatgctgttcctcataagcggcaagggggtaggcaagacaagcatcggtctgatctgcgtcgttgccagtagcggcatgttgtggatggccgacataccgctccagtggatcgcgtccgccatagtactagagttcttcatgatggtgctgctcatcccggagcccgagaaacagagaacgccccaggataatcagctggcctacgtagtgatcgggatcttgacgcttgccgccatcgtggcagcgaacgagatgggcctgctggagaccaccaaaagggacttgggcatgagcaaggagcccggggtcgtttccccgaccagctacctggacgtggaccttcaccccgcgtccgcctggacgctctacgctgtcgcgaccaccgtgataacccccatgctgcggcacacgatcgaaaacagcaccgccaacgtgtccctggccgccatcgccaaccaggcggtcgtgttgatgggtctggacaaggggtggcccatctcgaagatggacctgggcgtaccgctcctggccttggggtgctactcccaagtcaaccccctcacccttaccgccgctgtcctgctcctggtgacgcactacgccatcatcggccctggactgcaggcgaaggccacccgcgaagcccagaaacggacggccgccgggatcatgaagaaccctaccgtcgacgggatcatgaccatcgatctcgacccggtgatttacgacagcaagttcgagaagcagctgggccaggtgatgctgctcgtattgtgcgcggtgcagctgctcttgatgaggacctcctgggctttctgcgaggccctgaccctcgccacgggcccgatcacgaccttgtgggagggcagcccagggaaattctggaacaccaccatcgcggtgtccatggctaacatatttcgcggcagctacctggccggcgccggcctggcattctccatcatgaagtccgtcgggacgggcaagcgcggaaccgggtcccaaggcgagaccctgggggagaagtggaagaagaagttgaaccaactcagccggaaggagttcgacctgtacaagaagtccggcatcaccgaggtggaccgcacggaagcgaaggaagggctgaagagaggagagaccacacaccatgccgtaagtcgcggaagcgccaagctccaatggttcgtcgagcgcaacatggtgattcccgaggggcgcgtgatcgacctgggctgcggaagaggagggtggtcctactactgtgcaggtctgaagaaggtcaccgaggtgcgcggctacacgaagggcgggcctgggcatgaggaacccgtgcccatgagcacgtacggctggaacatagtcaaacttatgtccgggaaggacgttttctacctgccaccggagaagtgtgacactctgctctgcgacatcggagaaagctccccaagccccaccgtggaggagtcccggaccatcagggtcctaaaaatggtggagccctggttgaaaaacaaccagttctgcatcaaggtcttaaacccgtacatgccaactgtcatagagcacttggagcgcctgcagcggaagcacggcgggatgctggtgcgcaaccccctcagccggaactccactcacgagatgtactggatcagcaacggcaccgggaacatagtctcctccgtcaacatggtctcccgcttactgctgaaccggttcaccatgacgtaccgccgtcccaccatcgagaaggacgtggacctgggcgccgggaccagacatgtcaacgcggagccggagacgcccaacatggacgttatcggggaacgtatccgtcgtataaaggaggagcacagctccacgtggcactacgacgacgagaatccctacaagacctgggcctaccacggaagctacgaggtcaaggccaccgggtccgccagctccatgatcaacggcgtggtgaagctgctcacgaaaccctgggacgtcgtgccaacggtgacccagatggccatgaccgacaccacgcccttcgggcagcagcgcgtcttcaaagagaaggtcgacacccggacgcccaagccgatgcccggcactcgcaaagtgatggagatcacggctggttggctgtggagaaccctgggccgtaacaagcggccgcgcctctgtacgcgggaggagttcaccaagaaggttcgcactaacgccgccatgggcgccgtgttcacggaggagaaccagtgggactccgcacgtgccgccgtggaggatgaggagttctggaagctggtcgaccgggaacgtgagctgcacaagcaggggaagtgtggcagctgcgtgtacaacatgatggggaagcgtgaaaagaagttaggcgagttcgggaaggccaaggggtcccgggccatttggtacatgtggctgggcgcgcggtacctggagttcgaggcccttggtttcttaaacgaggatcattggttcagtcgcgaaaattcgtactccggcgtagagggggaaggccttcacaagttaggctacatcctgagggatatctccaagatccccgggggcgcgatgtatgccgacgacaccgccgggtgggacacccgcatcaccgaggacgacctgcataacgaggagaagatcacacagcaaatggacccggagcaccgccagctcgcgaacgccatattcaagctcacctaccagaacaaggtcgtgaaggtgcaacgccccacgcccaagggcacggtcatggacatcatcagccggaaggaccagcgaggctccggccaggtggggacctatgggctgaacacgttcaccaacatggaggcgcagctcatccggcagatggagggcgaaggggtcttaagcaagaccgacctggagaacccccacttgctggagaagaagatcacccagtggttagagaccaagggcgtcgagcgtttaaagcggatggccatctctggcgacgactgcgtggtgaagcctatcgacgaccgcttcgccaacgcgctgctggccttaaacgacatggggaaggtccggaaggacatcccccagtggcagccctcaaagggctggcatgactggcagcaggtccccttctgctcccaccactttcacgagcttataatgaaggacggccgcaagctggtggtcccgtgccgaccacaggacgagctcatcggccgcgcccggatcagccagggggctggctggagtctgaaggagaccgcctgcctgggcaaggcgtacgcgcagatgtgggcactcatgtacttccaccgccgcgatctgcggctagcaagtaacgcgatctgctccgccgtgcccgtgcactgggtccccacaagccgcacgacctggtccattcacgcccaccaccagtggatgaccaccgaggatatgctcacggtgtggaaccgggtttggatcgaggacaacccgtggatggaagacaaaacccccgtcaccacttgggaggacgtgccctacctggggaagcgcgaagatcagtggtgcgggagcctgatcgggctcacgtcccgggccacctgggcccaaaacattctaaccgcgatccagcaggtccgctccctgataggcaatgaggagttcctagactacatgccttcaatgaagcggtttcgcaaggaagaagagtccgagggggccatctggtaa

SEQ ID NO: 26195 - RNA, 9873 nt, synthetic construct
  misc_feature 1..9873: note = derived and/or modified CDS sequence (opt11) from DENV-3__AY858045__SS-prME
  source 1..9873: mol_type = other RNA
acaagcctgtgcctcatgatgatgctgccagctaccctggccttccacctcaccagccgtgacggggagccccgcatgatcgtggggaaaaacgagcgcggcaagagcctgctgttcaagactgcttccgggataaacatgtgcaccctcatcgcgatggacctgggggagatgtgcgacgacactatcacctacaagtgcccgctgatcacagaggtggaacccgaggacatcgattgctggtgtaaccttaccagcacctgggtgacgtatgggacttgcaaccaggccggagagcatcggagggacaaacggtccgtggccctggcgccccacgtgggcatgggtctggacacgcgcgcgcagacctggatgagcgccgagggcgcctggcgccaggttgagaaagtggaaacatgggccttccgccacccaggcttcaccatcctcgcgctgttcctggcccactatatcggtacctcgctcacccagaaggtcgtcatctttatcctgctgatgctcgtgacgcccagtatgaccatgcggtgcgttggggtaggaaacagagactttgtggagggcctgtccggagcgacctgggtcgacgtggtcctggagcacggtgggtgcgtcaccacgatggccaaaaacaagccgaccttagacatcgagctacagaaaactgaagccacccagctggcgacgctccgtaagctgtgcatcgagggcaagatcacaaacgtgaccaccgacagccgctgtcccacgcagggagaggccatcctgcccgaggagcaggaccaaaattacgtgtgcaagcacacttacgtcgaccgggggtgggggaacgggtgcggcctctttggcaaaggctcccttgtaacatgcgccaagttccagtgtttagagctcattgaaggcaaggttgtccagcatgagaacctgaaatacaccgtgattataacggtgcatacgggggaccaacaccaggtcgggaacgagactcagggggtgaccgccgagatcacgccgcaagcctcaaccgtcgaagcgatcctgcccgagtacggaaccctcgggctggagtgtagcccccggaccggcctggactttaacgagatgatcctcctgaccatgaagaataaggcctggatggttcaccggcagtggttcttcgacctgccactcccgtggacaagcggcgccacaacagaaacacccacgtggaacaagaaggaactgttagttaccttcaagaacgcccacgcaaagaaacaagaggtcgtggtgctcgggtcccaggagggggcgatgcataccgcgctgacaggggccacagagatccagaccagcggcgggacctccatcttcgccggccacctgaaatgcaggttgaagatggacaagctggaactaaagggcatgagctacgccatgtgctccaacgctttcgtcttgaagaaggaggtgagcgagacgcagcacgggactatcctgatcaaggtggagtacaagggtgaggacgcaccatgcaagatcccgttcagcaccgaggacgggcaaggcaaggcccacaatggccgattgatcaccgccaaccccgtcgtgaccaaaaaggaggagcccgtgaacatcgaggctgagcccccgttcggagagtccaacatcatcatcggcataggggataaggcccttaagatcaactggtacaagaagggtagctccattgggaagatgttcgaggctacggcccgcggcgcacggcgcatggcgatactcggcgacacagcctgggacttcgggagcgtaggaggagtactgaactccctgggcaagatggtccaccaaatttttgggtcggcctacaccgccatcttctccggtgtcagctggatcatgaaaatcggcatcggggttctcctgacctggataggcctgaactccaagaacacgagcatgtccttttcatgcatcgtgatcgggatcattacattatacctgggcgccgtcgtgcaggcggacatgggatgcgtgatcaattggaaggggaaggagttaaagtgcggaagcgggatcttcgtcaccaacgaggtgcacacatggacggagcagtacaagttccaagccgacagccccaagcggttggccaccgccatagccggcgcgtgggagaatggggtgtgcggtatccgctccaccactcggatggagaatctgctgtggaagcagatagcaaatgagctcaactacatcctgtgggaaaacaacatcaagctgacggtcgtagtgggggatatcataggcgtcctcgagcagggcaagcgtacactgacgccacagcccatggaactaaaatacagctggaagacttgggggaaggccaagatcgtgactgccgagatccagaactccagctttatcatcgacggccctaacaccccggagtgtcccaacgcgtcacgcgcctggaacgtgtgggaggttgaagactacgggttcggcgtgttcacgaccaacatctggctcaagctgcgtgagatgtacacgcagctgtgtgaccaccgcttaatgagcgccgctgtgaaggatgagcgggccgtccacgcggacatgggatactggatcgagagccaaaagaacggctcctggaagctggagaaagccagcctgatcgaggtgaagacctgtacttggcccaagtcccacaccctctggagcaacggcgtgctggagtccgacatgattattcccaaatcactggccgggcccatctcccagcataactatcgccccggctaccacacccagacggctgggccgtggcacctcggcaagctggagctagacttcaactactgcgagggcaccacggtcgtgataaccgaaaactgcgggacgcggggcccctccctccgcaccaccaccgtgtccgggaaattgatccacgagtggtgctgccggagctgcacgctaccgccactgcgctatatgggcgaggacgggtgctggtacggcatggagatccggccgatcaacgagaaggaggagaacatggtaaagtccctggttagcgccggctccgggaaggtggacaacttcaccatgggcgtcttgtgcctcgcgatcctgtttgaggaggtgatgcgcgggaagttcggcaagaagcacatgatcgcaggggtgctgttcatgtttgtcttgctgctgtcgggccagatcacctggcgcgacatggcccgcaccctcatcatgatcggctcaaatgcctccgaccggatggggatgggcgtgacgtatctggcactgatcgcgactttcgagatccagcccttcttagccctggggttcttcctgcgcaagctcacctcccgtgagaatctattgctcggcgtagggctggccatggccaccacactgcagctgcccgaagatatcgagcaaatggcgaacgggatcgccttgggtctaatggccctcaagctgattactcagttcgaaacctaccagctgtggaccgccctcgtaagcctgacgtgtagcaacacgatcttcaccctgaccgtggcatggcgaacggcgacgctaatcctggccgggatctccctgctccccgtgtgccagagctccagcatgcgtaagacggactggctgcctatgaccgtcgccgccatgggtgttccgccactgcccctcttcattttctccctgaaggacacgctgaagcgccgcagctggcccctcaatgagggggtcatggctgtgggcttggtgtccatcctggcgagctccctcctgcgaaacgatgtccccatggccggccccctggtggccggcggcctcctcatcgcctgctacgttattaccgggaccagcgccgacctgacagtcgagaaggcggccgacgtgacgtgggaggaggaggcggagcaaaccggcgtgtcccataacctgatgatcaccgtggacgacgacggaaccatgcgtatcaaggacgacgagaccgagaacatcctcaccgtgctgctcaagaccgcactgctgatcgtgtcaggcatcttcccttactccatcccggccactctcctggtatggcacacgtggcaaaagcagacgcagagaagcggcgttctgtgggacgtaccctccccgccggagacccagaaagcggagctcgaggagggagtctaccgcatcaagcagcagggcatattcggaaagacgcaggtaggcgtgggcgtccagaaggagggcgtcttccacaccatgtggcacgtgactcggggcgccgtccttacctacaacggcaagcgcctagagcctaactgggccagcgtgaagaaggatctcatctcctacggggggggttggcggctgagcgcccagtggcaaaagggggaggaggtgcaggtcatcgcggtagagcccggtaagaaccccaagaacttccagaccatgcccggtatcttccagaccacgaccggggagatcggcgcgattgccctggatttcaagccgggaacctcgggctcacccatcatcaaccgcgaaggcaaggtggtcgggctctacggcaacggggtggtgacaaagaacggcgggtacgtgagcggcatcgcccagacgaacgccgagcccgacggacccacccccgagctcgaggaggagatgttcaagaagcgtaacctgactatcatggacctgcaccccgggtcaggcaagacccgcaagtatctccccgcgatcgtgcgggaggccattaagcgccggctgcgcacgttaatcctcgccccgacccgggtggtcgccgccgagatggaggaggcactgaaggggctgccgatccgctaccagaccactgccacaaaaagcgagcacactggcaaggaaatcgtggacctcatgtgccacgccaccttcacaatgcggctgctgtcccccgtgcgcgtccccaactacaacctcatcatcatggacgaggcccacttcactgacccggcgagcatagcggcccgggggtacatctcgacccgcgtgggtatgggcgaggcggccgcgatcttcatgaccgccacgccgcccgggacggccgacgccttcccccagagcaacgccccgatccaggatgaagaacgagatatccccgagcgctcctggaacagcggaaacgactggatcaccgacttcgcggggaagaccgtgtggttcgtcccttccatcaaggccggtaacgacatcgccaactgcctgcgtaagaacgggaagaaggtgatccagctgtcacggaagaccttcgatacggagtatcaaaagaccaagctcaacgactgggatttcgtggtcacgaccgacatctccgagatgggcgccaacttcaaggccgaccgtgtgatagatcccagacgctgcctgaagccggtaatcctaacggacggacccgagcgggtcattctcgcggggcccatgcccgtgaccgtggcgagcgccgcccagagacggggccgcgtcgggcggaacccgcagaaggagaatgaccagtatatcttcaccggccagcccctgaacaacgatgaggaccacgcccactggaccgaggcgaagatgctgctcgataatatcaacactccggaggggatcatccccgccctattcgagccggagagagaaaagtccgcagccatcgacggcgagtaccggcttaaaggcgagagcaggaagaccttcgtggagctcatgcggcgcggggatctgcccgtgtggctggcgcacaaggtcgcctcagagggcatcaagtacaccgaccggaagtggtgcttcgacggggagcgcaataatcagatcctcgaggagaacatggacgtggagatttggaccaaggagggcgagaagaagaaactgcgaccccgctggctggacgcccggacctacagcgatcccctggccctaaaggaattcaaggacttcgctgcgggtcgcaagtccatcgctctagacttggtcacagaaatcgggcgcgtgccgagccacctcgcccacaggactcgtaacgccctggacaacctcgtgatgctgcatacctctgagcacggcgggcgggcctaccgccacgcggtcgaggagctgccggaaacaatggagacgctcctgctgctcggactgatgattctgctcaccgggggcgccatgctgttcttaatcagcggcaaaggggtggggaagaccagcattgggctcatctgcgtggtcgcctcctcaggtatgctgtggatggccgacatcccactgcagtggatagcctccgcgatcgtgctagagttcttcatgatggtgctgctaatcccggagcctgaaaagcagcggacgccccaggacaaccagctcgcctacgtcgtgatcgggatcctgacgctggccgccatagttgccgcgaacgaaatgggcctcctggagaccacaaagcgcgacctgggcatgagcaaggagcccggggttgtctcccccaccagttacctggacgtggacctgcaccccgcctccgcgtggacgctctacgccgtcgctaccaccgtgatcacgcccatgctccggcacacgatcgagaactcaaccgcgaacgtctccctggccgcgatcgctaaccaggcggtcgtgctgatgggtctagataaggggtggcccatcagcaagatggacctgggcgtgccactcctcgccctggggtgctactcccaggtcaaccccctgaccttgacggccgccgtgctgctgctcgtgacccactatgccatcatcggcccaggcttacaggcgaaggccacgcgtgaggcccagaagcgaaccgccgccgggatcatgaagaaccccacagtagacggaatcatgacgatcgacttggaccctgtcatctacgacagcaagtttgagaagcaactagggcaggtcatgctactggtcctttgcgccgtgcagctgctgctcatgcgtacctcctgggccttctgcgaggccctgaccctggccaccggccccataacgaccctttgggagggcagtcccgggaagttctggaacacgaccatcgcggtttccatggctaatatcttccggggcagctaccttgccggggccggcctggccttctccatcatgaagtcggtcgggacgggcaagcgcggcaccggaagccagggtgagaccctcggggagaagtggaagaaacgcctgaaccagctgtcccgcaaggagttcgacctctacaagaagtccggcatcaccgaagtggaccggacggaggcgaaggaggggctgaagcgcggcgaaatcacacatcacgcggtgtctaggggcagcgccaagctgcagtggttcgtagaacgcaacatggttatccccgaggggcgggtgatagacctcggctgcgggcgcggcgggtggtcctactactgtgccggactgaaaaaggtcaccgaggtgcggggatataccaagggcgggccggggcacgaggaacccgtccccatgagcacctacggctggaacatcgtcaagctgatgtccgggaaggacgtgttctacttaccgccggagaagtgcgacactctgctgtgcgacatcggcgagagttccccctcaccaaccgtggaagagtcgcgcaccatccgcgttttgaagatggtggagccctggctcaagaacaaccaattctgcatcaaggtgcttaatccctacatgcccaccgtcatcgagcacttggagcgtctccagagaaagcatggcggaatgctggtccgtaaccccctttcacgcaattctacgcacgaaatgtactggatctcgaacggcaccgggaacattgtgtccagcgttaacatggtgtccagactcctgctgaaccgcttcacaatgacctaccggcggcccacgatcgaaaaggacgtggacctcggcgccggcacccggcacgtcaacgcggagccggagacacccaacatggacgtgatcggggagcgcatccggcgcatcaaggaggagcacagctcaacctggcactacgacgacgaaaacccctacaagacctgggcctaccacgggtcttacgaagtcaaagccaccgggtccgcctcgagcatgataaacggcgtggtgaagctgctgaccaagccgtgggatgtcgtccccaccgtgacccaaatggccatgaccgacaccacccccttcgggcaacagcgggtcttcaaggagaaggtggacacccgcacacccaaaccgatgcccggcactcggaaagtgatggagatcaccgcggggtggctctggaggacgctggggcggaataagcgaccccggctgtgcacccgcgaggagttcacaaagaaggtccggaccaacgctgccatgggcgccgtattcacggaggagaaccagtgggactccgcgcgggccgccgtcgaggacgaggaattctggaaactcgtcgaccgcgagcgcgagcttcataagcaggggaagtgcggcagctgcgtgtacaacatgatggggaagcgcgagaagaagctgggagagtttggcaaggcgaaggggtcacgcgcgatctggtacatgtggctgggcgcgcgatacctggagttcgaagccctggggttcctgaacgaggaccactggttcagcagggagaactcctacagcggggtagagggggagggccttcacaagttaggctacatactccgcgatatctccaagatccccgggggcgccatgtacgccgacgacaccgccgggtgggacaccagaatcactgaggacgacctgcacaacgaggagaaaatcacgcagcaaatggacccggaacaccgccagctggcgaacgccatcttcaaactcacctaccagaacaaagtggtgaaggtgcagcggcctacccctaaagggaccgtcatggatatcatatcgcgcaaggaccagaggggcagcggccaggtgggtacgtacgggttaaacaccttcaccaatatggaggcccagctcatccgccagatggagggggagggggtgctctctaagaccgacctggagaatccccaccttctcgagaagaagatcacccagtggctggagactaagggcgtggagcggctgaagcgcatggccatctccggcgatgactgcgtggtgaagcctatcgacgaccggttcgccaacgcgctcctggccctgaatgacatggggaaggtccgaaaggacataccccagtggcaacccagcaagggctggcacgattggcagcaagttcccttctgctcacaccacttccacgagctcatcatgaaggacgggcggaagctggtggtcccttgccgcccccaggatgagctgatcggccgggcccgcatcagtcagggggccggctggtccctcaaggagaccgcctgcctcgggaaagcctatgcacagatgtgggccctgatgtactttcaccgccgtgatctccgccttgccagcaacgcgatctgctccgccgtgcccgtgcactgggtccccacaagccgtaccacgtggtccatccatgctcatcaccagtggatgaccaccgaagacatgctgaccgtgtggaaccgggtgtggattgaagacaacccgtggatggaggataagacgcctgtcaccacctgggaggacgtgccctacctcgggaagagggaggaccagtggtgtggcagcctgatcgggctgactagccgcgccacgtgggcccaaaacatcctcactgctatacagcaggtccgatccctgatcggcaacgaggagttcctggactacatgcccagcatgaagcggttccggaaggaggaggagtccgaaggggccatctggtga

SEQ ID NO: 26196 - RNA, 9873 nt, synthetic construct
  misc_feature 1..9873: note = derived and/or modified CDS sequence (opt11) from DENV-3__AY858046__SS-prME
  source 1..9873: mol_type = other RNA
accagcctgtgcctgatgatgatgctgcccgccacccttgccttccacctcaccagtcgcgacggtgagccgaggatgatcgtggggaagaatgagaggggcaagagcctgctcttcaagacggcatccggtatcaacatgtgtaccctcatcgccatggacctgggcgagatgtgcgacgacacgatcacctacaagtgccctttgatcaccgaggtggagcccgaggacatcgactgctggtgcaacctcaccagtacctgggtgacatacggtacctgcaaccaggtgggcgagcaccggcgtgacaaacggtcggtcgccctagcaccccacgtaggcatggggctcgacacccgcgctcagacctggatgagcgccgagggcgcctggcgtcaggtcgagaaggtcgagacttgggccttccgccaccccgggttcactatcctcgccctgttcttggcgcactacatcggcacctccctcacccagaaggtggtgatcttcatcctgttaatgctcgtcactcccagcatgaccatgaggtgcgtgggggtgggcaaccgcgacttcgtcgagggcctatccggcgcgacgtgggtggacgtagtcctggagcacggcgggtgcgtgaccacgatggccaaaaacaagcccaccctcgacatcgagctgcaaaagaccgaggccacccaacttgccaccctccggaagctgtgcatcgagggcaagatcaccaacgtgacaaccgacagccgctgcccaacgcaaggcgaggctatcttgccagaagaacaggaccagaactatgtctgtaagcacacctatgtagaccggggctggggcaacgggtgtggcctcttcgggaagggcagtctggtaacctgcgccaaattccagtgcctggagctcatagaggggaaggtcgtgcagcacgaaaaccttaaatacaccgtgattatcacagtgcacaccggggaccagcatcaggtgggcaacgagacgcaaggggtaaccgccgagatcacgccccaggccagcaccgtggaggccatcctgcccgagtacggtaccctaggactggagtgctcacccaggacaggcctggacttcaatgagatgatcctcctgaccatgaagaacaaagcgtggatggtgcacaggcagtggttctttgacctgccgctcccctggacgtcgggagccaccaccgagacaccgacgtggaacaagaaggagctgctggtcaccttcaaaaacgctcatgcaaagaagcaagaggtggtggtcctcgggtcccaggagggagccatgcacaccgcgttgaccggggccacggagatccagacctcgggcgggacctccatcttcgccggccacttgaagtgccgccttaagatggacaagctggagctgaaggggatgagctatgccatgtgctccaacgccttcgtgctcaagaaggaagtgagcgagacccaacacggcacgatcctgataaaggtcgagtacaagggcgaggacgcgccctgcaagatcccattcagcaccgaggacggacaaggcaaggcccataacggtcggctgatcaccgccaaccccgtggttaccaagaaagaggagcctgtcaacattgaggcggaacccccgttcggggagtccaacatcatcatcggcatcggggacaaggcactgaagataaactggtacaagaagggcagctccatcgggaagatgttcgaagccacggcccgaggcgcacggcgcatggcaattttgggcgacacagcgtgggattttggcagcgtgggcggggtgctgaactccttaggcaagatggtccaccagatctttgggagcgcctacaccgccctcttttccggcgtgagctggatcatgaagattggtatcggggtgctgctaacctggatcggcctcaactctaagaacacgagcatgtccttttcgtgcatcgtcattgggatcataactctgtacctgggggccgtggtgcaagccgacatggggtgcgtaattaactggaagggaaaggagctcaagtgtggctccggaatcttcgtgaccaacgaagttcacacctggacggagcagtacaagttccaagcggacagccccaaacggctagccacagctatcgcgggcgcctgggagaacggggtatgcggcatacgcagcaccacccgcatggagaatcttctctggaagcagatcgcaaacgagctgaactacatcttgtgggaaaataacattaagctcacggttgtggtcggggacatcatcggcgttctggagcagggcaagcggaccttaacgccacaacccatggagctcaagtactcttggaagacctgggggaaggctaagatcgtgactgccgagatccagaattcctcgttcatcatcgacggccccaatacccccgaatgtcccaacgccagccgcgcgtggaacgtctgggaggtggaggactacgggttcggtgtgttcaccaccaacatatggcttaagttacgggaaatgtacacgcagttatgcgatcaccggttaatgagcgccgccgtcaaggacgagcgggccgtgcatgccgacatgggttactggatagaaagccagaagaacgggtcctggaagctggagaaggcgagcttaatagaggtgaagacctgcacctggcccaagtcccacaccctgtggagcaacggcgtcctggaaagcgacatgattatccccaagtccctcgccggtcccatttcacagcacaactaccgccccgggtaccacacccagaccgcaggtccgtggcacctgggcaagctggagttggacttcaactactgcgagggaaccaccgtggtgatcaccgagaactgcggcacccgaggcccgagtcttcgcaccacaaccgtctccggcaagctgatccacgagtggtgctgccggagctgcaccctgccgcccctccgctacatgggcgaggacggttgctggtacgggatggaaatcagaccgataaacgaaaaggaggaaaacatggtgaagtccctggtgagcgcaggtagcggaaaggttgacaatttcaccatgggcgtgctctgtctcgccatcctgttcgaggaggtgatgcgcgggaagttcgggaaaaagcacatgatcgcgggggtcctgtttatgttcgtgttactgctcagcggccagatcacctggcgggatatggcccgcaccttgatcatgatcggcagtaacgccagcgaccggatggggatgggagtaacatacctcgccctcatcgccaccttcaagatccagcccttcctggcgctggggttctttttgcgcaagcttacctcccgagaaaacctgttgctgggcgtaggtctggccatggcaaccacgctccagctgcccgaggacatcgagcagatggcaaacgggatcgccctgggcctcatggccctgaagctgatcacgcagttcgagacctaccaactctggactgccttagtgtcgctgacgtgcagcaacaccatcttcaccctgacggtggcctggcggacggctaccctgatcctggccgggatctccctcctgcccgtctgtcagagctccagcatgcggaaaaccgactggctgccgatgaccgtggccgccatgggcgtcccgcctcttccactgttcattttctccctgaaggacacgctcaagcgccgcagctggccgttaaacgaaggggtgatggccgtaggcctggtgtctatcctcgccagcagtctgttgcgcaacgacgtgccgatggcaggcccccttgtggccgggggtctgctgatcgcgtgctacgtcattacggggacgtcagccgatctcaccgtcgagaaagctgcggacgtgacgtgggaggaggaggcggagcagaccggcgttagccacaacctgatgatcaccgtggacgatgacgggacaatgcgtatcaaggacgacgaaacagagaacatcctgaccgtgctcctgaagaccgccctactcatcgttagcggcattttcccttactctataccggcgacgctgttggtgtggcacacatggcaaaagcagacacaacggagtggcgtgctttgggatgttcctagccctcccgagacccaaaaggcagagttagaggagggcgtttacaggatcaagcaacagggcattttcgggaagacacaggtaggcgtcggtgttcagaaggagggggtgttccacaccatgtggcacgtcactaggggtgccgtgctcacctacaacgggaagcgcctcgaacctaactgggccagcgttaagaaggatctgatctcgtacggcggtggatggcgtttgagcgcccagtggcagaagggggaagaggtccaggttatcgccgtggagcccggcaagaaccctaagaactttcagaccatgcccggcatctttcaaaccacgaccggggagattggcgctatagccctggactttaagccggggaccagtggcagccccatcatcaaccgcgagggcaaggtcgtgggtctatacgggaatggggtggtcaccaaaaacggcgggtacgtatctggcattgcccagacgaacgccgagcccgatggcccgacacccgagctggaggaggagatgttcaagaaacggaacttaaccatcatggatttacaccccgggtcggggaagacacgcaagtacctgccagccatcgtgagagaagcgatcaaacgccggctgcgcacgctcatcctggcccctacccgggtagtggccgccgagatggaggaagcactgaaggggttaccaatacgctaccagaccacagcgacaaagagcgagcacaccggcaaggagatcgtggacctgatgtgccacgccaccttcacgatgcggctgctctcacctgtccgcgtgcccaattacaacctgataataatggacgaggcgcactttacggacccggcgagcatagccgcgcggggttacatatccacgcgcgtgggcatgggagaagccgctgccatattcatgacagcgacgccgcccggaacggccgacgctttcccccagagcaacgccccgattcaggacgaggagagggacatccccgagcgctcctggaacagcggcaacgactggatcaccgactttgccgggaaaaccgtctggttcgtgcccagtatcaaagcaggcaacgacatcgcaaactgcctgcgcaagaacgggaagaaagtgatccagctctcgcggaaaacattcgatacggagtaccagaagactaagctgaacgactgggacttcgtcgtgacgaccgacatctcagagatgggcgccaacttcaaggcggaccgggtgatcgatccccggcgctgcctgaagcctgtaattctcacagacggcccagaacgggtgatcctggccggtccaatgcccgtcaccgtcgcatccgccgcgcagcgccggggccgcgtggggcgaaacccgcaaaaggagaacgaccagtacatcttcaccggacaacccctcaataacgacgaggatcacgcccactggaccgaggccaaaatgctgcttgacaacatcaacacccccgagggaattatccccgcactgttcgagccagagcgcgagaagtccgccgccattgacggcgagtaccggttgaagggcgagagtagaaagaccttcgtagagctgatgcggcgcggggacctgcccgtctggctcgcccacaaggtggcctccgagggcatcaaatacaccgaccggaagtggtgtttcgatggggagcgcaacaaccaaatcctggaagagaacatggacgtagagatctggaccaaagagggcgaaaagaagaagctccggccgcgctggctagatgcccggacgtatagtgatcccctggctcttaaggagttcaaggacttcgccgccggacgcaagtccatagcgctcgatctggtgacggagatcgggcgcgttcctagtcacttagcccaccgtacccgcaatgcactcgacaacttggtcatgctacacacctccgagcacggggggcgagcctatagacatgccgtggaggagctcccagagacaatggagacactgctgctcctcggccttatgatcctattgaccgggggcgccatgctgtttctcatcagcggcaagggtgtggggaagaccagcatcgggctgatctgcgtcgtggcctccagcggcatgttatggatggccgacatccccttacagtggatcgcgtccgccatcgtgctggaattctttatgatggtcctcttaatcccggagcccgaaaagcagcggacgccccaggacaaccagctggcgtatgtggtgataggtatactaacgctcgccgccattgtcgccgccaacgagatgggaatgctggagaccacaaaacgagacctgggcatgtcgaaggagcccggggttgtgtccccgaccagctacctcgacgtagatctacaccctgcgtccgcttggacgctgtacgccgtggccaccaccgtcatcacccccatgctccggcacaccatcgagaatagcacagcgaatgtctccctcgccgccattgccaaccaagccgttgtgctgatgggcctcgacaaggggtggcccatcagcaagatggacctgggcgtacctctgttggcgctgggctgctactcccaggtgaaccccctgaccttgaccgccgctgtcttactgctcgtcacccactacgccatcattggccccggtctgcaggccaaggcgacacgcgaagcccagaagcggaccgccgccgggatcatgaagaaccccaccgtggacggtataatgacgatagacctggacccggtgatatacgactccaaattcgagaaacagctcgggcaagtcatgctcctggtgctctgcgccgtgcagctcctgctcatgcgcacctcctgggcgttttgtgaggccctgaccctggccacgggccccatcaccacactatgggagggctcgccagggaagttctggaacaccaccatcgctgtctccatggcgaacatcttccggggctcttacctcgccggggccggccttgccttctccatcatgaagtccgtgggtacgggcaagcgaggcactgggtcccagggcgaaaccctcggagagaagtggaagaagaagttgaaccagctgagccggaaagagttcgacctctacaagaagtccgggatcaccgaagtggaccgcacggaggctaaggagggactgcggcggggcgaaattacccaccacgcggtcagccgtggcagcgcaaagttacagtggtttgtggaacgcaacatggtgatccccgagggtcgggtcatcgacctcggctgcgggcgcggcgggtggtcctactactgcgccggcctgaaaaaggtcacggaggtgcgaggttacactaagggaggacctgggcatgaagaacccgtccccatgagcacatacggctggaatatagtgaagctgatgtccgggaaggatgtgttctacctcccgccggaaaagtgtgacacgttgttatgcgacatcggcgagtcttcccccagcccgaccgtcgaggagtctcgcaccatccgcgtgctgaagatggttgagccctggctcaaaaataatcagttctgcatcaaggtcctgaacccctacatgcccaccgtgatagagcatctggagcggctccaacgaaagcacggcgggatgttggtgcggaaccccctcagccggaactccacgcacgagatgtactggatcagcaacggcactgggaacatcgtctctagcgtgaacatggtgtcccggctcctgctgaacaggttcaccatgacctaccggcgccctacgatcgaaaaggatgttgacttaggcgccggcaccaggcacgtgaacgccgagccggaaacccctaacatggacgtcatcggtgagcgcatccggcgcatcaaagaagagcacagctccacatggcactacgacgacgagaatccatacaagacgtgggcgtatcatgggagctatgaggtgaaggccaccgggtccgcttcgtctatgatcaatggcgtagtcaagctgcttaccaagccgtgggacgtggtgcccaccgtcacgcagatggccatgaccgatactaccccctttgggcagcagcgggtgtttaaggaaaaggtggacacgcgtaccccaaagccgatgccgggtactcggaaggccatggagatcacagcaggatggctctggcgaacgctgggccggaacaaaaggccccggctgtgcacccgcgaagagttcaccaagaaggtcagaaccaacgccgccatgggggcagtgttcacagaggagaatcagtgggactccgcgcgcgccgcggtggaggacgaggagttttggaaactggttgatagggagcgggagctacacaagcaggggaaatgtggcagctgtgtgtacaatatgatggggaagcgcgaaaagaagctgggagagttcggcaaggccaagggttccagagccatctggtacatgtggctcggcgcgcgatatcttgaatttgaggccctaggtttcctcaacgaggaccactggttcagccgtgagaactcctattctggcgttgagggggagggcctgcataaactgggctacatcctccgcgacatctctaaaatcccaggcggcgccatgtacgccgacgacaccgccgggtgggacacccggataaccgaggatgacctgcacaacgaggagaagatcacgcagcagatggacccggagcatagacagctggcgaatgccatcttcaagctcacctaccagaacaaggtcgtcaaggtgcagaggcctacccccaagggaacggtcatggacatcatatcccgcaaggaccagcggggttccggccaggtgggcacgtacgggctcaacaccttcaccaacatggaagtgcagctgatccgccagatggagggcgaaggggtactcagcaagaccgacctcgagaacccccatttgctcgagaagaaaatcacccaatggctggagacgaagggggtggagcggctaaagcggatggccatctccggtgacgattgcgtggtcaagccgatcgacgatagattcgccaatgccctcttggcactgaatgacatggggaaagtgaggaaggatataccccaatggcagcccagcaagggctggcacgactggcagcaggtcccattctgttcccaccacttccacgagctcatcatgaaggacgggcggaagctagtcgttccctgtcggccgcaggacgagcttatcggcagggcccgcatcagccagggagccgggtggagcctaaaagagaccgcctgcctgggcaaggcctacgcgcaaatgtgggctttaatgtactttcatcgccgggatctccgcctggcctcaaacgccatctgctccgcggtgcctgtgcactgggtccctacgagtcggaccacgtggtccatacacgcgcatcaccagtggatgaccaccgaggatatgctgacggtgtggaaccgcgtctggatcgaggacaacccgtggatggaggacaagaccccagtgaccacatgggaggatgtgccctatctcggtaaacgcgaggatcagtggtgcggcagcctgatcgggctgacctctcgcgccacgtgggcccagaacattctcactgccatccagcaggtccgttccctgatcggtaacgaggagttcctggactacatgcccagcatgaaacgcttccggaaggaggaggagagtgagggggcgatctggtga

SEQ ID NO: 26197 - RNA, 9873 nt, synthetic construct
  misc_feature 1..9873: note = derived and/or modified CDS sequence (opt11) from DENV-3__AY858047__SS-prME
  source 1..9873: mol_type = other RNA
accagcctgtgcctcatgatgatgctgcccgccaccctggcctttcaccttacgtcccgcgatggcgagccccggatgatcgtcgggaagaatgaacgcggcaagtccttgctgttcaaaactgcgtcggggattaacatgtgcaccctcattgccatggacctcggcgagatgtgtgacgacaccgtcacctacaagtgccctctgatcaccgaggtggagcctgaggatatcgactgctggtgcaacctcactagcacttgggtgacgtacgggacctgcaaccaggccggcgagcatcggcgggacaagcggtccgtagcgctggcgccccacgtggggatggggctggacacccgcgcgcagacatggatgagcgcagagggcgcctggcggcaggtcgagaaggtggagacgtgggcctttcgccaccccggattcaccatcctcgcgctgttcctggcccactacatcggcacatccctaacccagaaagtggtgatctttatcctgctcatgcttgtcacgcccagcatgaccatgcggtgcgtgggcgtgggcaatagggactttgtcgagggcctgtccggggctacctgggtggacgtggtcctggagcacggcgggtgtgtgaccaccatggcaaagaacaagcccaccctcgacatcgaactgcagaagaccgaggcaacccagctggccaccctccgcaagctttgtatcgagggcaaaatcaccaatgtgactaccgacagccgctgcccgacacagggcgaggccattctgcccgaagagcaggaccagaactacgtctgcaagcacacctacgtggatcgggggtggggcaacgggtgcggcctcttcgggaaaggctccctagtgacctgcgccaagttccagtgtttagagctcatcgaaggcaaagtcgtgcagcacgagaaccttaagtacaccgtgattattacggttcacaccggggaccagcatcaggtgggcaacgagacgcagggtgtcactgccgagatcacgccccaggcgagcaccgttgaggcgatattgccggagtacggaacgttagggctggagtgtagcccccgcaccggcctggacttcaacgaaatgatcctcctgaccatgaagaacaaggcctggatggtgcaccggcaatggttcttcgacctgccgctcccctggacgagcggggccaccactgagaccccaacctggaacaagaaggagctgctggtgaccttcaagaacgcgcacgccaagaagcaagaggtggtggttctcgggtcccaggagggcgccatgcataccgccctgaccggggccacggaaatacagaccagcggcgggacctccatatttgccggccacctgaagtgccgcctcaagatggacaaattagagctgaagggcatgtcatacgccatgtgctccaacgcgttcgtgctcaaaaaagaggtgagcgagacccagcacggcacgatcctaatcaaggtcgagtacaagggcgaggacgctccgtgtaagatacctttcagcaccgaggacgggcagggaaaggcccacaacggacggctgatcacagccaaccccgttgtgaccaagaaggaagaaccagtaaacatcgaagccgagcccccgtttggggagtctaacatcatcatcggcatcggggataaggccctgaagatcaactggtataagaagggcagctccatagggaagatgttcgaggccacggcccgcggtgcgcggcgcatggcgatactcggcgacacagcctgggacttcgggagcgtgggcggggtgctgaactccctgggcaagatggtccatcagattttcgggagcgcctacacggccctcttctccggagttagctggatcatgaaaattggcattggggtcctcctgacgtggatcggcctcaatagcaaaaacacgagcatgtccttcagctgcattgtcatcgggatcatcaccctgtacttgggtgccgtagtacaagcggatatggggtgtgtcatcaactggaagggcaaggagctgaagtgcggcagtgggatcttcgtaaccaatgaggtgcacacctggacggagcaatacaagttccaggccgacagccctaagcggctggcgaccgcaatcgccggggcgtgggagaacggggtctgcggcatccgctccaccacccgaatggagaacctgctctggaagcagatcgccaacgagctgaactacatcctgtgggagaacaacatcaaactcacggtagtggtgggagacattatcggcatcctggagcagggcaagcgaaccctgacgccccagcccatggagttaaagtacagctggaagacctgggggaaggccaagatcgtgacggccgagatccagaattcgagcttcataatcgacggcccgaacacgcccgagtgtccaaacgcgtcccgcgcctggaacgtgtgggaggtcgaggactacgggttcggcgtgttcaccaccaacatctggctgaagctgcgggaaatgtacagccagctgtgcgaccaccgcctgatgagcgccgccgtgaaagacgagcgggcagtccacgcggacatgggctattggatcgagtcccaaaagaacgggagctggaagctagagaaagcctccctcatcgaggtgaagacttgcacctggcccaagagccacaccttgtggtccaacggcgtcctggagagcgacatgatcatcccgaagtcgttagcggggcccatcagccagcacaactaccgccccggctaccacacacagaccgccgggccatggcacctgggcaagctggagctcgacttcaactactgcgagggcacgaccgtcgttatcacagagaattgcggaacccgaggcccctctctgcgcacgaccaccgtgagcgggaaactgatccacgagtggtgctgtcggtcctgtaccctaccgcccctacgctacatgggcgaggacgggtgctggtacggcatggagatcaggccgatcaacgagaaggaggagaacatggtcaaaagcctggtgagtgccggcagcgggaaggtggacaacttcactatgggcgtcttatgcctggctatcctgttcgaggaggttatgcgagggaagttcggcaagaagcacatgatcgccggggtcctcttcaccttcgtcctgctgttatccggccagatcacctggcgtgacatggcccgcaccctaatcatgatcggcagcaatgcatccgatcgcatggggatgggcgtgacgtatctggcgctcatcgcgaccttcaagatccagcctttcctggccttagggtttttcttacgcaagctgacgagccgggagaacctgctcttgggcgtcggcctggccatggccaccacgctccagttgcccgaggacatcgaacagatggccaacgggatcgccctggggctcatggccctgaagctgattacccagttcgaaacctaccagctctggaccgcccttgtaagcctgatgtgctccaatacgatcttcaccctcaccgtggcatggcggaccgcgacattaatcctggccggtatttctctcctgcccctgtgccagtcctcatccatgcggaagacggactggctcccgatgaccgtggccgcaatgggcgtgccgcccctgcccctgttcatctttagtctcaaggacaccctgaagcgccgctcctggccgctgaacgagggcgtgatggcagtcggtctcgtgtccatactggcgtccagcctcctccggaacgacgtgcccatggccggccccctggtcgcagggggcctgctcatcgcatgctacgtgatcacggggacctccgctgacctgaccgtggagaaggcggccgatgtcacatgggaggaggaagccgagcagacgggcgtgagccacaacctcatgatcaccgtggacgacgatgggacgatgcgcatcaaggatgacgagaccgagaacatcctcacggtcctcctgaagaccgccctcttgatcgtgtccggcatcttcccatacagcataccggccacccttctcgtgtggcacacctggcagaagcggacccagcgatccggcgtcctgtgggacgtcccctctccgcccgaaacccagaaggcggaactggaggagggcgtgtataggatcaagcagcagggcatacttgggaagacacaggtcggcgtgggggtccagaaagaaggcgtcttccacaccatgtggcacgtgaccagaggcgccgttctgacgtacaacgggaagcggctggagccgaactgggcctccgtcaagaaggatctgatcagctatggcggcggctggaggctctccgcccaatggcagaaaggggaagaggtccaggtgatcgcggtcgagcccggcaagaaccccaaaaacttccagaccatgcccggcatatttcagactaccacgggggagatcggcgccatcgcactggacttcaagccggggacgtcaggcagccccatcatcaaccgggagggcaaggttgtggggctgtacggcaacggggtcgtgaccaaaaacggcggttatgtgtccggcatcgcccagaccaacgccgagcctgacggtcccacgcccgagctcgaagaggagatgttcaagaagcgcaacttaaccatcatggacctacacccagggagcggcaagacccgaaagtacctcccggcgatcgtccgggaggccatcaagcgtcgactgcggaccctgatcctcgccccgacgcgggtggtggccgccgaaatggaggaggcgcttaaggggctgcccatccggtaccagaccaccgccaccaagtccgagcacacaggcaaagaaatcgttgacttaatgtgccacgccacattcacgatgaggctactatcacccgtgcgggtgccgaactacaacctcattatcatggacgaggcccacttcaccgacccggcctccatcgcggctcgcgggtatatcagcacgcgggtcggtatgggcgaggccgccgcaatctttatgaccgccacgccgcccggtacagccgatgccttcccccaatccaacgccccgatccaggacgaggagcgcgatatccccgaacgcagctggaactcgggcaacgactggatcacggacttcgcggggaagaccgtgtggtttgtgccgagcattaaggccggcaacgacatcgccaactgcttacggaagaatggcaagaaggtcatccagctgtcccgcaagaccttcgacacggaatatcaaaagacgaagttgaacgactgggacttcgtggtgaccaccgacataagtgaaatgggcgccaacttcaaggccgaccgggtcatcgacccccgccggtgcctgaagccagtgattctgacagatggcccagaacgcgtgatactagcggggcccatgcccgtcacggtggcctcggccgcccaacggcgcggccgtgtggggcgaaacccgcagaaggagaacgaccagtatatcttcaccggccagcccctgaacaacgacgaggatcacgcccactggaccgaggcgaagatgctgctcgacaacatcaacacacccgaggggatcatcccagctctgttcgagccggagcgtgaaaagtccgccgccatcgacggagagtaccgcctgaagggggagtcccggaagacgttcgtagagctcatgcgccgcggggacctccccgtatggctagcgcacaaggtggcaagtgagggcatcaagtacacagaccgcaagtggtgctttgacggggagagaaataaccagatcctcgaggagaacatggacgtcgagatctggacaaaggagggcgagaagaagaagctgcgcccccggtggctggacgcccgtacatactccgaccccctcgctttgaaggaatttaaggactttgccgcgggccgtaagtctatcgccctggatctcgtgaccgagatcgggcgggtcccctcccacctggcccacagaacgcgaaacgcactggacaacctcgtgatgctgcataccagcgagcatggcgggcgcgcctaccgtcacgcggtggaggagctgcccgagaccatggagaccctcttactcctcggcctgatgatcctgctcacgggcggggtcatgctgttcctgatatcagggaagggggtcggtaagacatccatcgggctcatctgtgtggttgctagctccggcatgctgtggatggcagacatccccctgcagtggatagccagtgccatcgtgcttgagttcttcatgatggtgctcctgatcccggagccagagaaacagagaacgcctcaggacaaccagctcgcgtatgtcgtaatcgggatcctgaccctggccgcaatcgttgcggccaacgagatgggcctcctggagacgaccaagcgggacctgggcatgtctaaggagcccggggtcgcgagcccgacctcatacctcgacgttgacctgcaccccgccagcgcctggaccctgtacgccgttgcgacgaccgtcatcacccctatgctccgccataccatcgagaatagcacggcgaacgtaagtctggccgctatcgccaaccaggcggtggtccttatggggctcgataaggggtggcctatctcaaagatggacctgggcgtgccgctgctcgccctagggtgctacagccaggtgaaccccctgacactcaccgctgccgtcctgcttctcgtgacccattacgctatcatcggccccggcctgcaggcgaaggcaactcgggaggcccagaagcgcacagcggccgggatcatgaagaatcccaccgtggacggcatcatgaccatcgacctggatccggtcatctacgactccaagttcgagaagcagcttggccaggtgatgttgctggtgctctgcgcggttcagctgctgctcatgaggacgagttgggccttctgcgaggccctgaccctcgccaccggtccgatcaccacgctttgggaaggctctcccgggaagttctggaacaccaccatcgcggtgagcatggccaacatcttccgcggctcctacctggccggggccggcctggccttcagcatcatgaagtcagtggggacgggaaagcgggggacggggagccagggcgagaccctcggggagaagtggaagaagaagctgaaccaactaagccgcaaggagttcgacctttacaagaagtcaggcatcaccgaggtggaccgaaccgaggcgaaggaggggctgaagcgcggagagatcacgcaccacgccgtgagcagaggctccgccaagctgcagtggttcgttgagcgcaatatggtcatccccgaggggagagtgatcgacctcggctgcggtcgcggtgggtggtcctactattgcgccggcctgaagaaggtaacggaggtgcgaggctacacgaagggcggaccggggcatgaggaacccgtgcccatgtccacatacggctggaatatcgtgaaattaatgagcgggaaggacgtcttctatctgcccccggagaaatgcgacacgcttctttgtgatatcggcgagtccagcccctccccgacggtcgaagagagccgcaccatccgcgttctgaaaatggtcgagccgtggctcaagaacaaccagttctgcatcaaagtgctgaacccgtacatgccagccgtgatcgagcacctggagcggctgcagcgcaagcacgggggaatgctggtccgaaaccctctgtcccgcaatagcactcacgagatgtactggatctccaacggcaccgggaacatcgtttcatccgtgaacatggtcagccggctcctgctgaacaggttcacaatgacctaccggcgcccgaccatagagaaagacgtggacctcggcgcgggcacccggcacgtgaacgccgagccagagacgcctaatatggacgtcataggtgagcgcatccggcgcatcaaggaggagcactccagcacctggcactacgatgacgaaaacccctacaagacctgggcctatcacggctcctacgaggtgaaggcgaccggtagcgctagctccatgatcaacggcgtcgtaaagctgctgacgaaaccgtgggacgtggtccccaccgtgacccaaatggcgatgactgacacgacccccttcgggcaacagcgggtgttcaaagagaaggtcgacacacgcacccccaagccgatgcccggcacccggaaggttatggagatcactgctgagtggctgtggcgcaccctaggccgtaacaagcgcccccggttgtgcacccgcgaggagttcacgaagaaggttcgcaccaacgccgcgatgggggctgtctttaccgaagaaaaccagtgggacagcgcaaaggccgccgtggaggatgaggagttttggaagctcgttgatcgggagcgcgagctgcataagcttggcaaatgtgggtcctgcgtttataacatgatgggcaaacgggaaaagaagctcggggagttcgggaaggcgaagggaagccgcgcgatctggtacatgtggctgggggcgcggtacctggagttcgaggcactcggcttcctgaacgaggaccactggttctcccgcgagaacagctacagcggggtggagggcgaggggctgcacaagctcggctacatactgcgggacatcagcaagatcccaggcggtgcaatgtacgccgatgacaccgctggctgggacacgcggatcactgaggacgacttgcataacgaggagaagattacccagcagatggacccggagcacagacagctcgccaacgccatctttaagctgacctaccaaaacaaggtggtcaaggtgcagcgccccacgcccaaggggaccgttatggacatcatctcccggaaggaccagcggggcagtggccaggtcggcacctacggcctgaacaccttcacgaacatggaagctcagttaatccggcagatggagggggagggcgtgctatccaagaccgacctggagaatccccacctcctggagaaaaagatcacgcaatggctagagaccaagggggttgagagactcaagcgaatggccatatcaggtgacgattgcgtcgtgaagccgatcgacgaccgtttcgctaacgccctgctggctctgaacgacatgggcaaggttcggaaggacattccccagtggcagccctccaaagggtggcacgactggcagcaagttcccttctgcagtcaccattttcacgagctgatcatgaaggacggccgaaagctggtggtgccttgtcggccgcaggacgagctcatcgggcgcgcccggatttcccagggcgctggatggagcctgaaggaaacagcgtgcctgggcaaggcatacgcccaaatgtgggctttaatgtacttccaccgccgggacctgcggctggcgtccaacgccatctgcagcgccgtccccgtacactgggtgccaacatcccgcacaacctggagcatccacgcccaccaccagtggatgacgacggaggacatgctcatcgtctggaatcgggtgtggatcgaggacaacccgtggatggaggacaagacccccgtgaccacctgggaggatgtcccctacctgggtaagcgtgaggaccagtggtgtgggagcctgatcggcctcacgtcccgcgccacatgggcgcagaacatcctgaccgccatccagcaggtcaggtctctgatcgggaacgaggagttcctcgactatatgccctccatgaagcgtttccgcaaggaggaggagtcagagggcgccatctggtga

SEQ ID NO: 26198 - RNA, 9873 nt, synthetic construct
  misc_feature 1..9873: note = derived and/or modified CDS sequence (opt11) from DENV-3__HQ332170__SS-prME
  source 1..9873: mol_type = other RNA
accagcctgtgcttgatgatgatcctgcccgcagccctagcgtttcatctcacgagccgagatggagagccgagaatgattgtggggaagaacgagagagggaagtccctgctgttcaagactgcatccgggattaatatgtgcaccctcatagccatggacttgggtgagatgtgtgacgacaccgtgacctacaagtgcccccacatcaccgaggtggagcccgaagacatcgattgctggtgcaacctgaccagcacttgggtgacctatgggacctgcaaccaggccggagagcaccggcgcgacaagcggagcgtggccctcgcgccccacgtgggtatggggctggacacccgcacccagacctggatgagcgccgagggcgcctggcgccaagtcgagaaggttgagacgtgggcgctgcgacacccggggttcacaatcctcgcgctgttcctcgcccattacatcggcacgtccttgacccagaaggtggttatcttcattctattaatgttggtcacgccctctatgaccatgcgttgcgtgggggtgggcaaccgagacttcgtcgagggcctgtccggggccacctgggttgacgtggtcctggagcacggtggctgcgttaccacaatggccaaaaacaagcccacccttgacatcgagctgcagaagaccgaagccacgcaactggcgacgctccggaagttatgtatcgaaggcaagatcactaacatcaccaccgacagccgctgccccacccaaggcgaagcagtactaccggaggagcaggatcagaactacgtctgcaagcacacctacgtggaccgggggtggggcaacggatgtggcctcttcgggaagggctccctggtcacttgcgccaagtttcagtgcctggagcccatcgagggcaaggtggttcagtacgaaaacctcaagtacactgttatcatcacggtccacacaggagaccaacaccaggtcggcaacgagacccaaggggtgaccgctgaaatcacgccccaggctagcaccaccgaggcgatcctgcccgagtatggcacgctgggtttagagtgctccccgcgcactggcctggacttcaacgagatgatcctactcacgatgaagaacaaggcctggatggttcatcggcagtggtttttcgatctgcccttaccctggacctcaggcgccaccaccgagacgcctacctggaaccgcaaagagttgctggttacctttaagaacgcccacgcaaagaaacaagaagtggtggtattaggctcacaggagggcgcgatgcatacagccctcacgggggccaccgaaatacagaacagcggcggcacctccatcttcgccggacacctgaaatgccggctgaagatggataagctcgagctgaaaggtatgagctacgccatgtgcaccaataccttcgtcttaaagaaggaagtgtctgagacgcagcatggtactatccttatcaaggtggactacaagggcgaggatgtaccatgcaagatacccttcagcaccgaggacgggcaaggcaaagcgcacaacggccggctgatcaccgccaacccagtggtgaccaagaaggaggagcccgtaaacatagaagcagagccgcccttcggtgaaagcaatatagttatcggcatcggggacaacgccctgaagatcaactggtacaagaagggctcctctatcgggaagatgtttgaggcaaccgcacggggagcccgccggatggccatcttgggagacaccgcctgggacttcgggtccgtgggcggggtcctgaacagccttggcaaaatggtgcaccagatctttgggtccgcgtacacagccctgttcagtggagtatcctgggttatgaagatcggcatcggggtgttgctgacctggataggcctgaactctaagaacaccagtatgagcttctcatgcatagccatagggattatcactctctacttaggcgctgtggtccaagccgacacggggtgcgtgatcaactggaagggcaaagagcttaagtgcgggagcggaatcttcgtgactaacgaggtccacacctggacggagcagtacaagttccaggctgatagccccaaacggctcgcaacggccatcgccggcgcctgggagaacggggtctgcggaataaggagtaccacccggatggagaacctactgtggaagcaaatcgcgaatgagctcaactatattctgtgggagaacaacatcaagctgacggtggtcgtgggcgacatcataggcgtgctcgagcagggaaagcgcacgctgaccccccagccgatggagctcaagtattcttggaagacctgggggaaggccaagatcgtcaccgcggagacgcagaatagctcttttatcatcgatggccccaatacgcccgagtgccccagcgcctcccgggcgtggaacgtttgggaggtggaggactacggattcggggtcttcaccaccaacatctggcttaagctgcgcgaggtctatacccagcagtgcgaccaccgcctcatgagcgccgctgttaaggacgaacgcgccgtccacgccgacatgggctattggatcgagagccaaaagaacgggagctggaaactcgagaaggccagtctgatagaggttaagacgtgcacctggccgaagagtcataccctgtggagcaacggggtcctcgagtccgacatgattatccccaaatcgttagcggggcccatctctcagcataactaccggccgggctatcacacccaaacggcggggccctggcacttaggcaaactcgagctggacttcaactactgcgagggcacaaccgtcgtgattaccgaaaactgcgggacacgcggccctagcctgcggaccaccaccgtctccgggaaactcatccacgagtggtgctgccggagctgcaccctgccgcctttgaggtatatgggcgaggatggttgctggtatgggatggagattcgcccgatcagcgaaaaggaggagaacatggtcaaaagcttggtgtcagccggcagcggagaagtggacaacttcaccatgggagtactgtgcctggccatccttttcgaagaggtgatgcgggggaagtttggcaagaaacacatgatcgcgggggtgtttttcaccttcgtcctgctgctctccggccaaatcacgtggcgcgacatggcccatacgcttatcatgatcggctctaacgcctccgaccggatggggatgggcgtgacatacctggccctcatcgcgaccttcaagatacagcccttcttggcgctgggattctttctccgcaagcttacatcgagggagaacttgctcctgggcgtggggctggccatggcaacgaccctccaactgcccgaggacatcgagcaaatggccaacgggatcgcgcttggcctcatggccctgaagctgatcacccaattcgagacctatcagctctggacggccctgatcagtctgacctgctcaaacaccatcttcacgctcaccgtggcttggagaaccgctaccttgatcctggcgggcgtgagcctcctgccggtatgccagagctcgtctatgcgtaaaaccgactggctgcccatgactgtggccgccatgggcgtgccgccgttgccgctttttatcttcagcctgaaggacaccctcaagagacgcagctggcccttaaacgagggggtcatggctgtgggcttggttagcatcctcgcctccagcttactgcggaatgacgtacccatggcgggccctctcgtggcagggggcctgctgatcgcgtgctacgttatcactgggacctccgccgacctcacggtggagaaggccgcggacgtgacctgggaagaggaggccgagcagacaggcgtaagccacaacctaatgatcactgtagatgacgacgggaccatgcgcattaaggacgacgaaaccgagaacattctgaccgtgctccttaagaccgccctccttatcgtttccggcattttcccgtacagcatccccgccaccttactggtctggcacacatggcaaaagcagactcagcgtagcggggtcctttgggatgtcccatcaccgcccgaaactcagaaggccgagctggaagagggtgtgtaccgcatcaagcagcagggcatcttcgggaagacccaggtcggtgtgggggtccagaaggagggagtcttccatacgatgtggcacgtaacacggggcgccgtccttacgtacaacggcaagcgcctcgagcccaactgggcctctgtgaagaaggacctgatctcgtacggcgggggctggcggctgtccgcccagtggcagaagggggaagaggttcaggtcatagcagtggagcctgggaaaaaccccaagaactttcagaccatgcccggcactttccaaaccaccaccggggaaataggcgcaatcgccctcgacttcaagccaggtactagcggcagccccatcatcaaccgcgagggcaaggtggttggactgtacgggaacggtgtggtcaccaagaacggaggatacgtctccggaattgcccagacaaacgccgagccggacggccccactcccgagctggaagaggaaatgttcaaaaagcggaacctgacaatcatggacttacatcccgggagcggcaagacccgcaagtatctgccggccatcgtgcgggaggcaatcaagcgccggctgcgcacactcatcctagcgcccaccagggtggtcgccgctgagatggaagaggccctgaaggggctcccgatacgctaccaaaccactgcgacgaagtccgaacacaccggccgggagatcgtggatctgatgtgccacgccacgttcaccatgcgcctgctaagccccgtacgggttccgaactacaatctaatcatcatggacgaggctcacttcaccgaccctgcatccatagccgcgcgcgggtacataagtacccgggtgggtatgggagaggccgctgccatattcatgacagcgacgcctcccggaactgccgatgcttttccgcagtccaatgcccccattcaggacgaagagcgcgatatccccgagcgctcttggaattcaggcaacgaatggatcaccgacttcgccgggaaaacggtgtggttcgtcccctctatcaaggccggcaatgatattgccaattgtctacggaagaacgggaagaaggtcatccagctatcacgcaagacattcgacaccgagtaccagaagacgaagttaaacgattgggattttgtggtcacaacggacatatcagaaatgggcgccaacttcaaggccgacagggtcatcgacccgagacggtgtctgaaacccgtaatactcacagatggccccgagagggtcattctcgcgggtcccatgccggtgaccgccgcttccgccgcgcagcgtcgcggtcgggtggggcgtaatccacagaaggaaaacgaccagtacatctttaccggccagccactgaacaatgacgaggaccatgcccactggactgaagcgaagatgctactggacaacatcaatacccccgaggggatcatcccggccctttttgagcccgaacgggaaaaaagtgccgccatagacggcgagtaccgcctcaagggcgaatcccgtaagacctttgttgaactgatgcgccgaggcgacctacccgtgtggctcgcgcacaaggtcgcttccgagggcatcaagtacaccgacaggaagtggtgcttcgacgggcaacggaacaatcagattctggaggagaacatggacgttgaaatctggacgaaagaaggcgagaagaaaaagttgcgcccacggtggctcgatgcgcgcacctactccgatcccctggccttgaaagagttcaaggacttcgcggcgggccgcaagagcatcgccctcgatctggtgacggagatcgggcgggtcccctcccacctggcacaccgcacccgcaatgccctcgacaacctggttatgctgcatacctcagagcacggcggcaaggcctaccgccacgccgtggaggagctccccgagaccatggagaccctactgctcctgggcctgatgatcttactgaccggtggtgccatgctgttcctcatttcgggaaaagggatcggcaagacaagcatcgggctgatctgtgtgatagccagctccggcatgctgtggatggcggagatcccgctccagtggatcgcctccgcgatcgtgctggagttctttatgatggtgctcctcatcccagagcccgagaagcagcggacgccccaggataaccaacttgcttatgtcgtaatcggaatcctgaccctcgcggccatcatcgccgcaaacgagatgggcctgctggagactacgaaacgcgatctcggcatgtctaaggagccgggggtggtttcccctacctcctacctggacgtggaccttcaccccgccagcgcctggaccctctacgctgtagcgacgaccgtcattacccccatgctgcggcacaccatcgagaacagtacagcgaacgtgagcctagccgccatcgccaaccaggctgtggtactcatgggcctggacaaggggtggccaatttctaagatggatctgggtgtacccttgttggcgctgggttgttattcgcaggtgaaccccctcacgttaactgcggctgtcctcctcctgattacgcattacgccatcatcggcccgggccttcaggcgaaggcgacccgcgaggcccagaaacggactgctgcagggattatgaaaaacccgacagtggacggcataatgaccatcgacttggaccccgtgatctacgattccaaatttgaaaagcaactcggtcaggttatgttgctcgtgctgtgcgcggtgcaactgctcctcatgcgcacgagctgggccttatgcgaagcactcactctggcgactggccccatcaccactctgtgggagggctcccccggaaagttctggaacacaactatcgcggtaagtatggccaacatttttcgcggctcatacctcgccggagccggcctagcattcagcatcatgaaatccgtggggaccggcaagcgcggaactggcagccagggtgagaccctgggggagaagtggaagaagaagcttaaccagttgagccgcaaggagttcgacctgtacaaaaaatcaggtatcactgaggtggaccgcaccgaggcgaaggaggggctcaagcggggcgagatcactcaccatgccgtcagccgcggtagcgccaagttgcagtggttcgtggaacggagcatggtgatcccggaggggcgagtaatcgacttgggctgcggtcgggggggttggtcctactactgtgccggcctcaagaaggtgaccgaagtgcgcggttacaccaagggcgggcctggacacgaggagcccgtacccatgagcacctacggttggaatatcgttaagcttatgtccgggaaggacgtgttctacctcccgcccgaaaagtgcgacacgctcctgtgcgacatcggggaatcctcccctagtccaaccgtcgaggagtcgcggacaatcagagtgctgaaaatggtggaaccgtggctgaagaacaaccaattttgcatcaaagtcctaaacccatacatgccaaccgtgatcgagcatctggagagattacagcgtaagcacggcggtatgctcgttcgcaatccactgtctcggaactcgacccacgaaatgtactggatctcaaacggcaccgggaacatagtcgcctccgtcaacatggtgagtcgattgctgctgaaccggttcacgatgacccaccgccgtcctaccattgagaaagatgtggacctgggtgcgggcacccgccatgtgaacgccgaacctgagacgcccaacatggacgtgatcggggagcgaatcaagcgcatcaaggaggagcacaactccacatggcactatgacgacgagaacccgtacaagacctgggcgtaccacggcagttatgaggtcaaggcaaccggttccgcgagctcaatgatcaacggtgtggtcaaactccttactaagccgtgggacgtggtgcccatggtcacacagatggctatgactgacacgacgccctttgggcagcagcgggtgtttaaggagaaggtggacacccgaaccccgcgatccatgcccggcaccagacgtgtcatgggcatcacggccgaatggctatggcgtacactcgggcgaaacaagaagccccgcctgtgcacccgtgaggaattcaccaagaaagtgcgtacgaatgccgccatgggtgcggtctttaccgaggagaaccagtgggactctgctaaggccgccgttgaagatgaagacttctggaagctggtggaccgcgagcgggagctccacaagctggggaagtgcggctcctgcgtttacaacatgatggggaaacgcgagaagaagctgggtgagttcggcaaggccaagggttcgcgggcgatctggtatatgtggctcggcgctcggtaccttgagttcgaggctctgggcttcctaaatgaggatcactggttctcacgggagaactcttatagcggcgttgagggtgagggcctgcataagctgggctacatcctccgcgacatatctaagatccccgggggcgccatgtacgcagacgacaccgctgggtgggacacccgcatcacggaggacgacctgcacaacgaggagaagatcacccagcagatggaccccgaacacaagcagctggccaacgccatcttcaagctcacctatcagaataaggtcgtgaaagtacaaaggccgacccccacaggcacggtgatggatatcatcagccggaaggatcaacggggcagcggccaggttggcacctacggactgaacaccttcaccaacatggaggcccagcttattcggcaaatggaaggcgagggggtgctctccaaagccgacctggagaatcctcacctccccgagaagaagatcacgcaatggctggagaccaagggcgtggagcgcctgaagcgaatggcgataagcggtgatgactgcgtggtcaaaccaatcgacgaccgcttcgcgaacgccctgctggctctgaacgacatgggtaaagtgcggaaggacatcccgcagtggcagccctccaagggctggcacgactggcagcaggtccccttctgttctcaccacttccacgaactgatcatgaaagacggtcgcaagcttgtcgtgccctgcaggcctcaagacgaattaatcggccgcgcccggatcagtcagggggcaggctggagcctgcgcgagacggcctgcctcggcaaggcatacgcgcagatgtggtccctgatgtacttccaccggagagatcttcggctcgctagcaacgccatctgctccgccgtgccagtccactgggtgccgacctcgagaacgacctggtccattcacgcccaccaccagtggatgaccaccgaggatatgctaacggtgtggaaccgcgtctggattgaggacaatccctggatggaggacaagacgccggtcacaacctgggaaaacgtgccctacctagggaagcgtgaggaccagtggtgcggcagtctcatcgggctgaccagccgcgccacctgggcgcagaacatacctaccgctatccaacaggtccggtccctgatcggcaacgaagagtttctcgactacatgcccagcatgaagcggttccggaaggaggaggagagtgagggggccatctggtga

SEQ ID NO: 26199 - RNA, 9873 nt, synthetic construct
  misc_feature 1..9873: note = derived and/or modified CDS sequence (opt11) from DENV-3__AY858038__SS-prME
  source 1..9873: mol_type = other RNA
acctcgctgtgcctcatgatgatgctgccggcaaccctggccttccatctcaccagccgggatggggagccgcggatgatcgtggggaagaacgagcggggcaagagcctgctgttcaaaactgcctcagggataaacatgtgcaccctgatcgccatggaccttggcgagatgtgcgacgacaccgtgacgtataagtgccccctgataacggaggtggaacctgaggacatcgactgctggtgcaaccttacaagcacctgggtgacgtacgggacctgtaaccaggccggggagcaccggcgcgataagcggagtgtggccctggcacctcacgtcggcatggggctggacacccgcacccagacgtggatgagcgccgagggcgcctggcgccaggttgagaaggtggagacttgggccttccgccatccggggttcaccatcctcgccctgttcctggcgcactatataggcaccagtctcacgcagaaggttgtgattttcattctgctgatgctcgtcacccccagcatgactatgcggtgcgttggggtgggcaaccgcgacttcgtggaaggcctgagcggtgccacctgggtggacgtggttctggaacacggcgggtgcgtgacgaccatggctaagaacaagccaaccttagacatcgagctgcagaagaccgaggccactcagctggccacactacggaagctgtgcatcgagggcaagatcaccaacgtgacaacggactcgcgctgccccacccagggcgaagcgatcctgccggaggagcaagaccagaactacgtctgcaagcacacctatgttgacagagggtggggcaatgggtgcggattatttgggaagggctcccttgtaacatgcgccaagttccagtgcctggagagcatcgagggcaaggtggtgcagcacgaaaacttgaagtacacagtgatcatcaccgtccacacaggggatcaacaccaagtgggcaacgagacgcagggggtcactgccgagatcacgccccaagcctccaccgtggaggccattctgcccgagtacggtacgctggggctcgagtgctctccccgcaccggactggatttcaacgagatgattctgctcactatgaaaaacaaggcgtggatggtacaccggcagtggttcttcgacctgccgctcccctggacttccggcgccaccaccgagacgcccacctggaacaagaaggagctcctggtcaccttcaagaacgcgcacgccaaaaagcaggaggtggtggtactggggtcccaagagggcgccatgcacaccgcgctcacgggggccaccgagatccagacctccggcgggacctctatcttcgccggccatctgaagtgccgcctgaagatggacaagctcgagctgaagggcatgtcgtacgccatgtgcctgaacgcattcgtgctcaagaaggaagtgagcgagacgcagcatggtaccatcctgattaaggttgaatacaaaggggaggacgcgccctgcaagatcccgttcagcaccgaggacggacagggcaaggcccacaatggcaggctgataaccgccaaccctgtggtgacgaagaaggaggaacctgtcaacatcgaggccgagcccccgttcggggagtccaatatcgtgatcggcatcggggacaaggcgctgaagatcaactggtataagaagggcagctccatcgggaagatgttcgaggccactgcccgcggcgcccggcgcatggccatcctcggcgacaccgcgtgggacttcgggtctgtgggcggggtcctgaactccttgggcaagatggttcatcagatcttcgggagcgcctatacggccctctttagcggcgtgtcatggattatgaagatcggcatcggggttctgctgacgtggatcggcctaaattccaagaacacttctatgtccttcagctgcatcgccatcgggatcatcaccctttacctgggcgccgtggtccaggcggacatggggtgcgtcatcaactggaagggcaaggagctcaagtgcggctccggaatcttcgtgaccaatgaggtgcatacctggaccgagcagtataaattccaagccgacagccccaagcggctggccaccgccatcgccggtgcgtgggagaacggggtgtgcggaatcagatcgaccacgaggatggagaacctgttatggaagcagatcgccaacgagttaaactacatcctgtgggagaacaacatacggctcaccgtggtagtcggggacaccatcggcgtgctgcagcaaggcaagcgcaccctaccgccccagccgatggagttaaaatacagctggaaaacgtggggtaaggccaaaatcgtaaccgccaagacccaaaactccagcttcatcatcgatggccccaacactcccgaatggccctccgcgtccagggcctggaacgtttgggaagtggaggactacgggtttggcgtgttcacgaccaacatatggctgaagctgcgcgagatgtacacccagctctgcgaccatcgtctgatgagcgccgccgtcaaggacgagcgcgccgtccatgcggacatgggatactggatcgaatcccagaagaacgggagctggaagctggagaaggcctccctcatcgaggtcaagacctgcacctggcccaagagccacacgctttggtccaacggcgtactcgagtctgacatgattatccccaagtccctcgcagggcccatttcccagcacaactaccggccgggctaccacacccaaactgccgggccttggcatctgggcaagctggaactcgacttcaactactgcgagggcaccacggtggtgatcaccgagaattgcgggacccgcggcccgtccctgcggaccactaccgtcagcgggaagctgatccacgagtggtgctgccgctcctgtaccctaccacccctacggtacatgggggaggacgggtgttggtacggcatggaaattcggcccatcaacgagaaggaggagaacatggtcaagagccttgtgtcggccggtagcgggaaggtggacaacttcaccatgggcgtcctgtgcctggctatactgttcgaggaggtgatgcggggtaaattcggcaagaagcacatgatagccggggtccttttcacgttcgtgttactactatccggccaaattacctggcgcgacatggcccggaccctgatcatgatcggctctaacgccagcgaccgcatggggatgggcgtgacctacctagccctcatagcgacgttcaagatacagcccttcctggccttagggttctttctccggaagctgacctctcgcgagaacctgcttctgggcgtcggcctggcgatggccacgaccctccagctgcccgaggacatcgaacaaatggcgaacgggatcgccctgggcctcatggccctcaagctggtgacgcagtttgagacctaccagctctggaccgccctggttagtctgatgtgctccaacaccatcttcacgctcacggtagcctggagaaccgcaaccctgatcttggccgggataagcctcttgcccgtgtgccagtccagctccatgcgcaagacggattggctgcccatgaccgtagccgcgatgggcgtgccgcccctccccctgttcatctttagccttaaggacaccctcaagcgccgttcctggcccctgaacgagggagtaatggccgttggactcgtgagcattctcgcgtcctccctgctgcggaacgacgtgcccatggccggccccctcgtcgccgggggcctcctgatcgcctgctacgtgatcaccgggacatctgccgacctcaccgtggagaaggcggccgacgtcatctgggaggaggaggccgagcagaccggtgtgagccacaacttaatgatcaccgtggatgacgacggaacgatgcggatcaaggacgacgagaccgagaacatcctgaccgtcctgctaaagaccgccctgctgatcgtgtccggaatcttcccgtacagcatccccgccaccctgctggtttggcatacgtggcagaagcaaacccagcgcagtggagtactctgggacgtgcccagcccacccgagacgcaaaaggcggaattggaggaaggagtctaccggatcaagcagcaaggcatctttgggaaaacccaagtcggagtgggggtgcagaaggagggcgtcttccacacgatgtggcacgtgactcgcggcgccgtgctgacccacaatggcaagcgacttgagcctaactgggcctcggtcaagaaggatctgattagctacggcggcggctggcgcctatccgcacagtggcagaagggggaggaggtccaggtgatcgcggtcgagcccggcaagaaccccaagaatttccagaccatgcccggcatctttcagacgaccacgggcgagataggcgccatcgccctggacttcaagccagggacgagcggcagtcccatcatcaaccgggagggtaaggtcgtaggtctctacggcaacggtgtggtcacgaagaacggcgggtacgtgtcaggcatagcccagaccaatgccgagcccgacggccccacccccgagctggaggaggagatgttcaagaagcgcaacctgaccataatggacctgcaccccgggagcggcaagacgcggaagtacctgccggccatcatccgcgaggccatcaagcggcgtctaaggaccctcatactggcccccacccgcgtcgtcgccgccgagatggaggaggcgctgaaggggctccctatccggtatcagaccacggccaccaagtccgagcacaccggcaaggagatagtcgaccttatgtgccacgcaaccttcacgatgcgcctgctcagccccgtccgggtgccgaactataacctcataatcatggacgaggcccactttaccgatcccgccagtatcgcggcccgcgggtacatcagcacccgtgtggggatgggcgaggcggccgcgatatttatgacggccacaccgcccggtaccgctgacgccttccctcagtccaacgcccccatccaggacgaggagcgcgacatacccgagcgcagctggaactccggaaacgactggatcaccgacttcgccgggaagaccgtttggttcgtgccaagcatcaaggccggcaacgatatcgccaactgtctgcggaagaacgggaaaaaggtgatccagctctcccgcaagacgttcgacactgagtatcaacggaccaagttaaacgactgggacttcgtggtgaccaccgacatcagcgaaatgggcgccaacttcaaggccgaccgcgtgatcgacccgcggcgctgcctgaagcccgtcattctcaccgacggccctgagcgggttattctggccggacccatgccggtgacagtcgcctccgccgctcaacgccggggccgcgtggggcggaacccccagaaggagaatgaccaatacattttcaccggccagcccctgaacaacgatgaggatcatgcccattggacggaagcgaagatgctcctggacaacataaatacccccgaggggatcataccggccctgttcgaacccgagcgtgagaagtccgccgctatcgacggcgaataccggctcaagggcgagtcccgaaagacttttgtggagctgatgcggcgcggggacctgcccgtatggctcgcgcataaagtggccagcgaaggcatcaagtacaccgaccgcaagtggtgcttcgacggggagcgcaacaatcagatcctggaggagaatatggacgtcgagatctggaccaaggagggcgagaagaagaagctgcggcccagatggctcgacgcacgcacttattccgatccgctggccctcaaagagttcaaggacttcgctgcggggcgcaaaagcatcgccctcgacctggtgaccgaaatcgggcgtgttccctcccacctggctcaccggactcgcaacgccctcgacaacctggtcatgctgcacacaagtgagcacggcggacgggcctaccgccacgcggtcgaggagctccccgagacgatggagaccctgttgctcctgggcctgatgatcctcctgaccgggggcgccatgctgttcctcatcagcggcaaaggaatcggtaagacctccatcgggctgatttgcgtggtcgcaagctctgggatgctgtggatggccgacgtgccgcttcaatggatcgccagcgcgatcgtactagagttcttcatgatggtgctgctcatccccgagcccgagaagcagcggacgccccaggacaaccagcttgcctacgtcgtgatcgggattctgactttagccgccatcgtcgccgcaaacgagatgggcctcctggaaaccacgaaacgcgacctcggcatgtctaaggagccgggggtggttagtcccacgtcctacctggacgtcgacctgcatcccgctagcgcctggaccctctacgccgtggccaccaccgtgattacgcccatgctgagacacaccatcgagaactccaccgcaaacgtctcactggccgctattgccaaccaggcggttgtcttgatgggcctggacaaggggtggccgatctccaagatggacttgggcgtcccactcctcgcgctgggctgctatagccaggtgaaccccctcactctgacggccgccgtacttttactggtaacccactatgccattataggcccaggcttgcaggcgaaggcaacacgcgaggcccagaagcggaccgcagccgggattatgaagaacccgacggtggacggcatcatgaccatcgaccttgaccctgtgatctacgactccaaattcgagaagcagctggggcaggtcatgctgctcgtgctgtgcgcggtgcagttgctcctaatgcgcaccagctgggccttctgcgaggccctgacgttggccacgggccccatcaccaccctgtgggagggctcccccgggaagttctggaacacaactatcgcggtgagcatggccaacattttccggggttcctacctggcaggggccggtctcgccttcagtatcatgaaatcggtggggaccggcaagcgcggcaccgggtcgcagggagaaaccctgggggagaagtggaaaaagaagctgaaccagctcagcaggaaggagttcgacctatacaagaagtccgggataacggaggtggaccgcaccgaggcgaaggagggactgaagcggggcgagattacccaccacgccgttagccgcggctccgcaaagctacagtggttcgtcgaacggaacatggtcataccggaggggcgcgtcatcgatctgggctgtgggagaggcgggtggagctattattgcgccggcctgaagaaggtgaccgaagttcgcgggtacaccaagggcggaccagggcatgaggaacccgtgcctatgtccacatacggctggaacatcgtgaagctcatgagcgggaaggacgtattctacctgccgcccgagaagtgcgataccctgctgtgcgacattggcgaatccagcccctcacccactgtcgaggagagcagaacaattcgcgtgctcaagatggtggaaccgtggctcaaaaacaatcagttctgcatcaaggtcctgaacccctacatgcccacggtcatcgagcatctcgagcgcctgcagcggaagcacggcgggatgctggttcgcaaccccctcagtaggaatagcacccatgagatgtactggatcagtaacggcaccgggaatattgttagctccgtgaacatggtgagccgcctgctgctcaatcggttcaccatgacccaccgccggccaaccattgagaaggacgtcgatctgggcgccggcacacgccacgtgaacgcggagcctgaaacccccaacatggacgtcatcggggagcgcatcaggaggatcaaggaggagcattccagcacgtggcactacgacgacgaaaacccgtacaagacctgggcctatcacggctcgtatgaggtgaaggccaccggtagtgccagctccatgatcaacggtgtggttaaactgttaaccaagccctgggacgtggtgcccaccgtaacgcagatggccatgaccgacaccacgccctttgggcagcaacgcgtgtttaaggagaaggtggacacccggaccccgcgccctatgccgggtactcggaaggtcatggaaataacggccgagtggctgtggcgcactctgggccgaaacaaacgcccccgcctctgcacacgggaagagtttaccaagaaggtgcgcactaacgccgccatgggtgccgtgtttacagaagagaaccagtgggacagcgcgcgggcggccgtcgaggacgaggagttctggaaactggtggaccgcgagcgggagctgcacaagctcggcaagtgcgggtcctgtgtgtataacatgatgggaaagcgtgagaaaaagctgggggaatttggcaaggcgaagggcagccgggccatctggtacatgtggctcggggcgcgctacctagagtttgaggccctgggatttctgaacgaggaccattggttctcgcgggagaacagctactccggagtcgagggtgaggggctccacaaactgggctacatcctgcgcgacatcagcaaaatcccgggcggggccatgtacgccgacgataccgccggatgggatacccggatcacggaggacgaccttcacaatgaggagaagatcacccagcaaatggaccccgagcaccgccagctggctaacgccatcttcaagctgacctaccaaaacaaggtggtgaaggtccagcggcctacccccaaggggacggttatggacatcatctcccgcaaggatcagcggggcagcggccaagtggggacctacggtctcaacaccttcaccaacatggaggcgcagctgattcgccagatggagggggagggggtcctgagtaaggccgacctagagaaccctcacctactggagaagaagataacccagtggctcgagacgaagggggtcgagcggctaaagcgcatggccatcagcggcgacgattgcgtggtgaaacccatcgatgaccggtttgcgaacgcgttgctcgccctgaatgacatgggcaaggtgcgcaaggacatcccacaatggcagccctccaagggttggcacgattggcagcaagttcccttctgttcccaccattttcacgagttgatcatgaaggacggccggaagctcgtcgttccctgcagaccgcaagacgagctgatcgggcgcgcccggatctcccagggcgccgggtggtccctgaaggagaccgcgtgtctcggcaaggcctacgcccagatgtgggccctgatgtacttccaccgccgggacttacgcctcgcgagcaatgctatctgctcggccgtgccggtccactgggtgcccacctcccggactacgtggtccatccacgcccaccaccagtggatgacaacggaggatatgctgaccgtctggaaccgcgtctggatcgaagacaacccgtggatggaggataagacgccagtgaccacctgggaagatgtgccctacctgggcaagcgggaggaccagtggtgcgggagcctcatcggcctgacctcccgggctacgtgggctcagaacatcctgaccgctatccagcaggtccggtctctcatcggtaacgaggagttcctggactacatgccgagcatgaagcgcttccgcaaggaggaggagagcgagggagccatttggtga

SEQ ID NO: 26200 - RNA, 9873 nt, synthetic construct
  misc_feature 1..9873: note = derived and/or modified CDS sequence (opt11) from DENV-3__AY858039__SS-prME
  source 1..9873: mol_type = other RNA
acatccctgtgtctcatgatgatgctgccggcgaccctcgcgttccatttgaccagccgggacggtgagccccggatgatagtcgggaaaaacgagcgcggaaagtctctactcttcaagaccgcctccgggatcaacatgtgcacgttgatcgccatggacctgggcgagatgtgcgacgacactgtgacctacaagtgcccgctgataactgaggtggagccggaggatatcgactgctggtgcaacctcacctcgacttgggtgacgtacgggacctgcaaccaggccggcgagcatcggcgcgacaagcggtccgtcgctctcgcaccacacgtgggcatgggactggacactagagcacagacctggatgtcggcagagggcgcctggcggcaggtcgagaaggtcgagacgtgggccttccgccaccccgggttcacaattctcgcgctgttcctggcccattacattggcacatccctcacccagaaggtggtgatcttcatcctgcttatgctcgtcacccccagcatgactatgcggtgcgtgggtgtgggcaatcgcgatttcgtcgaggggctgtccggggccacatgggtggacgtagtcctggagcatggcgggtgtgtgaccacgatggccaaaaataagccgactctcgatattgagttacagaagacggaggccacccagctagcgacgctccggaagctgtgtatcgagggcaaaatcaccaacgtgaccaccgactcgcgttgccccacgcagggcgaggccatactgccggaggagcaagaccaaaactacgtctgcaagcatacctacgtcgatcgggggtggggaaacgggtgtggtctcttcggaaaaggctccctggtgacatgcgccaaattccagtgcctggagctcatcgagggcaaggtcgtgcagcacgagaacctcaaatatacagtgatcatcacggtccataccggagaccagcaccaggtgggcaacgagacccagggagtcaccgctgagatcacaccccaggcctcaaccgttgaggcaatcctgcccgaatatggcaccctcgggctggagtgctcacctcgtaccggcctggatttcaacgaaatgatactcctgaccatgaagaacaaggcctggatggtacaccggcagtggttcttcgacctgccgctcccgtggacgtccggcgccaccaccgagacccccacgtggaacaagaaagagttgctggtcaccttcaagaacgcccacgcaaagaaacaggaggtcgtggtcctcgggtcccaggagggcgccatgcacaccgcgctgaccggcgccacggagatccaaacgagcggagggacctccatcttcgccggccatctgaaatgccggctcaagatggacaagctggagctaaaaggcatgagctacgccatgtgctcaaacgcgttcgtactcaagaaggaggttagcgagacccaacatggtacgatcctgatcaaggtagagtataagggcgaggacgccccctgcaagataccgttctcgacagaggatgggcagggcaaggcacacaatggtcggctaataaccgccaaccccgtcgtaacgaagaaggaagaacccgtcaacatcgaggcggagcccccgttcggggagtccaacatcattataggcatcggggacaaggccctgaagatcaactggtataagaagggcagctccatcgggaaaatgttcgaggctacggctcgcggcgcccggcgcatggcgatcctcggagataccgcgtgggactttgggagcgtgggcggggtgctaaactctctcggcaagatggtccaccagatctttgggagcgcctataccgctctcttcagcggggtaagctggatcatgaagattggcatcggggtgctgctgacttggataggattaaactccaagaacacaagtatgtccttctcatgcatcgtcatcgggatcattaccctgtacttgggagccgtggtgcaggcggacatgggctgcgtcataaactggaagggcaaggaacttaagtgcggttccgggatctttgtgacgaacgaggtgcacacctggacggagcagtacaaattccaggcagacagccctaaacggctggccaccgcaatcgccggagcctgggagaatggtgtctgcggcatcaggtccaccacccgcatggagaaccttctctggaagcagatcgccaacgagctgaactacatcctgtgggagaacaacatcaagctcacggtggttgtcggggacattatcggggttctagagcagggaaaacgaaccctgacgccccagcccatggagttaaaatacagctggaaaacctgggggaaggcgaagatcgtgacggctgagatccagaacagtagcttcatcatagacggcccaaacacccccgaatgccctaacgcatccagggcctggaatgtttgggaggtcgaggactacgggttcggagtgttcacgaccaacatctggcttaagctgcgggagatgtacacgcagctctgcgaccaccgcctgatgagcgccgcggtcaaggacgagcgggctgtacacgcggatatgggatactggatcgagagccagaagaacgggtcgtggaagctggagaaggcgagcctcatcgaagttaaaacctgcacatggcccaagtcccacacactgtggagcaacggcgtcctggagtccgacatgataatcccgaagtcccttgccgggcctattagccagcacaattaccgcccagggtaccacacccagacggccgggccttggcacctgggcaagctggagctcgatttcaactactgcgagggcaccaccgtggtgatcacagaaaactgtgggacgcgtggccccagccttcgcactacaaccgtctccgggaagctgatacacgagtggtgctgccggagctgcacgctgccgcccctccgctatatgggcgaggacgggtgctggtacggcatggaaatccggccgatcaatgagaaggaggagaacatggtgaagtcactggtctctgccggctctgggaaggtcgacaacttcaccatgggcgttctctgcctggctatcctgttcgaagaggtcatgcgcgggaagttcggcaagaagcacatgattgctggcgtactctttatcttcgttctgctgctcagtggtcagatcacctggcgcgacatggctaggaccctgatcatgatcggctccaacgccagcgaccggatggggatgggcgtaacgtacctagccctcatcgcgaccttcaagatccagccattcctggcgctggggttctttctcaggaagctgacctcccgggagaacctgttgttaggcgtcggactcgccatggccaccacgctccagctacccgaggacatcgagcagatggcgaacgggatcgcgcttggcctcatggccttgaagctgatcacccagttcgagacctaccagttatggaccgctctggtgtcgctgacgtgcagcaataccattttcaccctcaccgttgcctggcgcacggcaacgctgatcctggcagggatctccctcctgcccgtttgccagagctcgagcatgcgcaagaccgattggctgcctatgaccgtggccgcgatgggtgtgccacccagccccctcttcatcttctccctgaaagacacgttaaagcgacgctcttggccgctcaacgagggggtaatggccgtgggcctggttagcatcctggcgtccagcctcctgcggaacgatgtgcccatggcgggccccttggtggccggagggctcctaatcgcctgctacgtaatcacagggacttccgcggatctgaccgtggaaaaagcggccgatgtgacgtgggaggaggaggccgagcagaccggcgtctcgcacaacttgatgatcacggttgacgatgatgggaccatgcgcatcaaagacgacgagacggagaacatcctgaccgttctcctaaaaaccgccttactgatcgtctccggaatcttcccctacagtatcccggcaaccctactcgtgtggcacacctggcagaagcagacacagcgttccggcgtgctatgggatgtccccagcccgcccgaaacccagaaggccgaactcgaagagggggtttaccgcatcaaacagcggggaatcttcgggaaaacccaggtgggcgtcggcgtgcagaaggagggcgtgttccacacaatgtggcacgtcactcgcggagccgtactcacatataacgggaagcggctggagccgaactgggcctccgtgaaaaaggacctcatcagctacggcgggggttggcgcctgtccgcacagtggcagaagggggaggaggtccaagtgatcgcggtcgaaccgggcaaaaaccccaagaactttcagacaatgcccggtatctttcagaccacgaccggggaaatcggcgccatagctctggacttcaagccagggaccagcggttcacccatcatcaaccgggaaggcaaggtcgtgggactgtacggcaatggggtggtcaccaagaacggaggctacgtgtccggcatcgcccagacgaacgccgagcccgacggcccgacgcccgagctcgaggaggagatgttcaaaaagcgcaatcttacaatcatggatctgcacccggggagcgggaagacccggaaatacctcccagcgatcgtgcgcgaagccatcaagcggcgcctgcggaccctgatcctcgccccaacacgggtcgtggccgccgagatggaggaggcgctgaaggggctgccgatccggtaccagacgaccgccacgaagagtgagcacacgggcaaggagatagtggatctcatgtgccacgccacatttaccatgcggttactgagccccgtccgggtcccgaactacaacctcatcatcatggatgaggcccacttcacggacccggcctccatcgcggcgcgcgggtatatctcgacacgggtcggcatgggcgaggccgcagcgatcttcatgacagcgacgccgcctgggacggccgacgccttcccccaatccaacgccccgatccaggacgaggagcgcgacatccccgagcgcagctggaactcgggtaacgactggatcaccgactttgctggtaagaccgtctggttcgtgcccagtatcaaggccgggaacgatatcgccaactgtctgcggaagaacgggaagaaggtgatacagctgtcccggaagaccttcgacacggagtaccagaaaaccaagctcaacgactgggacttcgttgtgaccaccgacatcagcgagatgggcgccaattttaaggccgatcgggttatcgaccccaggaggtgcttgaaaccggtcatcctgacggatggcccggagcgcgtgatactagcggggcctatgcccgtaaccgtcgcgtccgcagcccagcggagagggcgggttggccgcaacccgcagaaagagaacgatcagtacatcttcaccggccagcctctgaacaacgacgaagatcacgcacactggactgaggcgaagatgcttctcgataatattaacacacccgaggggatcatccccgccctgttcgagcccgagcgagagaagtccgccgccatcgatggcgagtaccgcctgaagggcgagtcccggaagacctttgttgagctcatgcgccgcggggaccttcccgtctggctggcgcacaaagtggcctctgagggcataaagtataccgaccgcaagtggtgttttgacggggaacggaacaaccagatcctcgaggagaacatggacgtcgagatctggacgaaggagggagagaagaaaaagctgcgcccccggtggctggacgcaaggacctattccgacccgctagcgctgaaggagttcaaggacttcgccgcaggcagaaagagcatcgccctggacctcgtgacggagattgggcgggttccgtcccaccttgcccacagaacccggaatgccttagacaacctggtcatgctgcacactagcgagcacggagggcgggcctatcggcacgcggtggaggagctgcccgaaactatggagaccctccttctgctcggcctgatgatcctgctcacaggaggcgccatgctgttcctgatcagcggcaagggggtgggcaagacgtccataggtctcatttgtgtggtggccagctcaggcatgttatggatggccgacatccccctgcagtggatcgcctccgcgatcgtcctcgagttcttcatgatggtcttactgatcccagagcctgagaagcagcgaacaccccaagacaaccagctcgcctacgtggtcatcgggatcctgacgctggccgcgattgtcgctgcaaacgagatgggcctgctggagactaccaagcgtgaccttggtatgtccaaggagcctggtgtggtgagcccaacctcctacctcgacgtcgacctgcaccccgcctcagcgtggacgctgtatgcggtcgcgaccactgtgattacccccatgttgcggcacacgatcgagaactctaccgccaacgtctccctggccgcgatcgccaaccaggctgtggtgctgatgggcctcgataaggggtggcccatatctaagatggacctgggcgtcccactgctcgccctggggtgctatagccaggtgaacccactgacccttactgcggccgtgctattactcgtcacgcactacgccattatcggacccggcctgcaggccaaggccacccgggaggcacaaaaacgcaccgccgcagggatcatgaagaaccccaccgtggacggcatcatgacgatcgacctggacccggtaatctacgactccaagtttgaaaagcagctcggacaagtcatgctgctcgtgctctgcgcggtgcagctgctgttaatgcggaccagctgggccttctgcgaggccctgaccctggcgaccggccccatcacgaccctctgggagggatccccagggaaattttggaataccaccatagcggtcagcatggccaacatcttcagaggctcctacctggccggggccggcctggcgttcagcattatgaagagtgtggggacggggaagcggggaaccgggagccagggcgagaccctcggggagaagtggaagaagaaacttaaccaactgagccgcaaggagttcgacctctacaaaaagtccggcatcaccgaggtggatcgcacagaggccaaggaaggactgaagcgcggcgagatcacccatcacgccgtaagccgggggtccgctaagttgcagtggttcgtggaacgcaacatggttatccccgaaggaagagtcattgacctcggctgcggacgcggagggtggagctactattgtgcaggcctgaagaaagtgaccgaggtgcggggctacaccaagggcgggccagggcatgaggaacctgtccccatgtccacctacggctggaacatcgtcaagctgatgagtgggaaggacgtcttctacctcccacccgaaaagtgcgacacgctcttgtgcgacattggcgagtccagcccctcgcccaccgtcgaggaaagccgcaccatccgagtactgaagatggtggaaccctggctaaagaataaccagttctgcatcaaagtcctgaacccctatatgcccaccgtaatcgaacacttagagcggttacaacgtaaacacggcgggatgctggtgcggaaccccctgtcccgcaattcgacacatgagatgtattggatatccaatggcactgggaacatagtcagctccgtgaacatggtgagccggctcttactaaaccgcttcaccatgacctaccggcgccccacgatcgagaaggatgtcgacctcggcgctggaacccggcatgtgaacgcggagccggaaacgcccaacatggatgttatcggggagcgcatccggcgaataaaggaggagcattcgagcacatggcattatgacgacgagaatccctacaagacatgggcctaccacggttcctacgaggtcaaggccacggggagcgccagctccatgatcaacggcgtggtaaagctgctgaccaagccgtgggacgtggtgcccaccgtcacgcaaatggcaatgaccgataccaccccgttcggtcagcagcgggtgttcaaggagaaagtagacacacgcacacccaagcctatgcccggcacacggaaggtcatggagatcaccgcagagtggctctggcgcactcttggcagaaacaagcgccctcggctgtgcacccgcgaagagtttacgaagaaagtccgcaccaatgccgccatgggggccgtgttcacagaggagaaccaatgggatagcgcgcgtgccgcggtcgaggacgaggagttctggaagctggtggatcgggagcgggagctgcataagctgggcaaatgcgggtcctgcgtatacaacatgatgggcaagcgcgagaagaagctcggggagtttggcaaggccaagggtagccgcgcaatctggtacatgtggctgggagcgcgctacctggagttcgaggccctcgggttcctgaacgaggaccactggttctcccgggagaacagctactccggggtcgagggggagggcctgcacaaacttggctacatcctgcgcgacatcagcaagattccaggcggggcaatgtatgcagacgacacggccggctgggacacgcggattaccgaggacgacctgcacaacgaggagaagataacacagcagatggacccggagcaccgccagttggctaacgcgatattcaagctgacctaccagaacaaggtggtgaaggtccagagacccacccccaaggggacggtgatggacatcatttcccggaaggaccagcggggcagcggccaggtgggtacgtacggcttaaacaccttcaccaacatggaggcccaactcatcagacagatggagggggagggcgtcctgagcaagaccgacctggagaacccccacctcttagagaaaaagatcacccaatggttggagaccaagggcgtagagcggttaaagcgtatggctatcagcggcgacgactgcgtcgtcaagccgatagacgacaggttcgccaacgcgctgttagccctcaacgacatgggcaaggtgcgcaaggacatccctcagtggcagccctccaagggatggcatgactggcagcaggtccccttctgcagccaccacttccacgaactgatcatgaaggacggccgaaaactggtcgtgccgtgccgacctcaggatgagctcatcgggcgtgcaagaatttcccaaggcgcggggtggagcctgaaggagaccgcctgcctgggcaaggcgtacgcccagatgtgggccttgatgtacttccatcggcgtgatctgcgcctggcctccaacgcgatctgctctgccgtaccggtacactgggtgccgacttcccggactacgtggagcatacacgcccaccatcagtggatgacgactgaggacatgctcacggtatggaatcgcgtctggattgaggataacccttggatggaggacaagacgcccgtcactacgtgggaagacgtaccctacctgggcaagcgggaggaccagtggtgcgggagtctgattggcctcacctcacgtgccacgtgggcacaaaatatcctaaccgctatacagcaggtccgcagcttgatcgggaacgaggagttcctcgactacatgccctcaatgaagcgcttcagaaaggaggaggaaagcgagggtgcaatctggtaa

SEQ ID NO: 26201 - RNA, 9873 nt, synthetic construct
  misc_feature 1..9873: note = derived and/or modified CDS sequence (opt11) from DENV-3__JN368477__SS-prME
  source 1..9873: mol_type = other RNA
accagtctgtgcctcatgatgatgctgcccgctaccttagccttccacctcacctctcgggacggcgaaccgcggatgatcgtgggtaagaatgagcgcggcaagtccctgctgtttaagaccgcttccgggatcaatatgtgcacgctcatcgcgatggacctcggcgagatgtgtgacgacaccgtcacctacaagtgtccgctgatagccgaggtggagcctgaggacatcgactgctggtgcaacctcaccagcacctgggtgacgtacgggacttgcaaccaagccggcgagcaccggcgagacaagcggagtgtcgccctggcgccacacgtgggcatgggcctggacacccgcacccagacctggatgagcgccgaaggggcgtggcgccaagtcgagaaggtcgagacgtgggcgctccgccacccggggttcaccatacttgcactgttcttagcccactacattggaacctccctgactcagaaggtagtgatattcatcctgctcatgctggtcacgccgagtatgaccatgcgttgcgtaggcgtgggtaaccgcgacttcgtcgagggcctgtccggggccacgtgggtggacgtggtcctagagcacggcgggtgtgttaccacgatggccaagagcaagcccaccctggatatcgagctgcagaagaccgaggccacccagctcgcgacgctgcggaagctgtgcatcgagggcaagatcacgaacattaccaccgactccagatgccccacgcaaggtgaggccaccctgcccgaggagcaagaccagaactacgtatgcaagcacacctacgtcgaccgggggtggggcaacgggtgtggcctgttcgggaagggcagccttgtgacatgtgctaagttccagtgcctcgagcccatcgagggcaaagtagtccagtatgagaatctgaagtataccgtgatcatcaccgtgcacaccggggaccagcatcaggtgggcaacgacacccagggtgtgaccgtcgaaatcaccccacaggcctccactgtggaagccgtactaccagagtacggcacccttgggctcgagtgcagcccgcgcaccggcctggattttaatgagatgatcctcctgacgatgaagaacaaggcgtggatggtacatcgacagtggtttttcgacctgcccctcccctggacctctggggccaccaccgaaacgcccacttggaaccgcaaggagctgcttgtgaccttcaagaacgcccacgctaaaaagcaagaggttgtcgtgctcgggagccaggagggtgctatgcataccgcactgaccggggcgaccgagatccagaacagtggtgggaccagcatcttcgccgggcacctgaagtgcaggctgaagatggacaagctggagctgaaaggcatgtcctacgcaatgtgtttgaacacctttgtgctgaagaaggaggtcagcgagacccaacacgggaccatcctgatcaaagtcgagtataagggcgaggacgccccgtgcaagatccccttcagcaccgaggacgggcagggtaaggcacacaacggccgcctgataacggcaaatcccgtggtcacgaagaaggaggagccggtgaacatcgaggccgagccgccatttggggaatccaacattgtgatcgggattggggataaggccctcaagatcaactggtacaagaagggcagctccatcggaaaaatgttcgaggccacggctagaggcgcccgccggatggccatcctaggtgataccgcctgggactttggtagcgtcggaggcgtgctgaacagtctcggcaaaatggtgcaccagatcttcgggagcgcctataccgctcttttcagtggggtcagctggatcatgaagatcggcatcggggtgctactcacttggatcggcctgaactccaagaacacctcaatgtcattcagctgcatcgtgatcggaattatcaccctatacctcggcgccgtcgtgcaggccgacatggggtgtgttatcaattggaagggaaaggagctgaagtgtggaaacgggatcttcgtcacaaacgaagtgcacacctggaccgagcagtacaagttccaagccgactccccaaagcgtctggcgacggccattgccggtgcatgggagaacggggtgtgcggcatccgcagcaccacgcgcatggagaatctcctttggaagcagatcgcaaacgagctgaactacatcctctgggaaaacaacataaagctgacggtcgtcgtgggggacatcatcggggtcttggagcagggcaagcgcaccctcacaccccagcccatggagctgaagtatagttggaagacctgggggaaggcgaaaatcgtgaccgccgagacccagaacagctccttcatcattgacggccccaacactcccgagtgcccaagcgcctcacgagcttggaacgtgtgggaggtcgaggactacggtttcggcgtgttcactacaaatatctggctgaagctccgcgaagtatatacccagagctgcgaccaccgcctgatgagcgcagccatcaaggacgagcgcgccgtccacgcagacatgggctactggatcgagtcccagaagaacggaagctggaagctagagaaggcgtcctttatagaggtgaaaacgtgtacctggcccaagagccacactctctggtccaacggcgtgctcgagagcgatatgatcatccccaaaagcctggcgggacccatctctcagcacaaccaccggccggggtaccacacccagaccgctgggccctggcacctcggcaagctggagctggacttcaactattgcgagggcaccacggtagtgatcgctgagaactgcgggacccgcggcccttcgctgcggacgacgacggtaagcggcaaacttatccacgagtggtgctgccgctcctgcaccctgcccccactccggtatatgggagaggacgggtgctggtacggcatggagatcaggcccattaacgaaaaagaggaaaacatggtcaagagtttggtctccgccggaagcgggaaggtggataacttcacgatgggcgtcctgtgtctcgccattctgttcgaagaggtgatgcggggcaagttcggcaagaagcacatgatcgcgggcgtgctgtttaccttcgtgttactgctgagcggccagatcacgtggagggacatggctcacaccttaataatgattggtagcaacgctagcgaccggatgggtatgggcgtgacccacctggccctgatcgcaaccttcaaaatccagcccttcttagcactggggtttttcctgcgcaagctaacgtccagggagaacctgctgcttggggtaggtcttgccatggccaccaccctgcaactccccgaggacatcgagcagatggccaacggtatagcgctaggcttgatgaccctgaaactgatcacgcaattcgagacctatcaactgtggacagcgctcgtctccctgacttgctccaatacgatcttcaccctgacagtggcatggcgcacggccacactcatcctggccggggtcagcctgctcccactgtgtcagagcagctccatgcggaagacagactggttacccatgaccgtggcggcaatgggcgtgccgccccttcctctcttcatcttcagcctgaaagacacgcccaagcgtcgctcatggccactcaacgagggggttatggccgtgggcttggtctccatacttgcctcctcactcctgcggaacgacgttccgatggcgggccccctagttgccggtgggctgctgatcgcctgctatgttatcacgggaacttctgctgacctgactgtcgagaaggccgccgacgtgacctgggaggaggaggcggaacagacgggggtgtctcataacctcatgatcacggtcgacgatgacggaaccatgcgtatcaaggatgacgaaaccgagaacatcctgaccgtgctgctcaagacggctctgctcatcgtgtccggaatcttcccctactctatccccgcaaccctcctggtctggcacacctggcaaaaacagacgcagcggtccggcgtgctctgggacgtgcctagccctcccgagacgcagaaggccgagctcgaagagggtgtctacagaatcaagcagcagggaatctttgggaagacccaagtgggcgtgggggtccagaaggagggcgtgttccacaccatgtggcacgtgacccggggcgcagtcctgactcacaacgggaagcgcctggaacccaactgggcctccgtgaagaaagacctgatctcctacggcggaggctggcgcctgtccgcccaatggcagaaaggggaagaggtacaggtcatcgccgtggagccaggcaagaacccgaagaactttcagacaatgcccggcatcttccagaccaccacgggggaaataggggcaatcgcgctggatttcaagccaggcaccagcggcagcccgatcatcaaccgcgagggcaaggtggttgggctgtatgggaacggggtggtgaccaagaacggcgggtacgtatccggcatcgcccagacgaacgccgagcctgacggccccacgcccgagttggaggaggaaatgttcaagaaacggaaccttaccatcatggacctgcatccggggagcggcaagacccgcaagtatctccccgccatcgtgcgagaggccatcaaacgccggctgcgcaccttaatactcgcgcctacgcgggtggtcgccgccgagatggaagaagccctaaaggggctaccgatccgctaccaaactaccgccacaaagagtgagcacaccgggcgggagatcgtggacctcatgtgtcacgcgaccttcactatgcgtctgctcagcccggtgcgggtccccaactacaatctcgtcatcatggacgaggcgcacttcaccgaccccgcaagcatcgcggcacggggctacatcagcacgagagtaggtatgggcgaggcggcggccatcttcatgaccgccaccccgcccgggaccgcggaagccttcccccagtcaaacgcacccatccaggatgaggagcgcgacatccccgagcgcagttggaactccggcaatgagtggatcacggatttcgtcgggaagaccgtttggttcgtgcccagcatcaaagccggcaatgacatcgcgaactgcttacggaagaacggtaagaaggtcatccagctctcacgcaagaccttcgacaccgaataccagaagacgcggctcaacgactgggactttgtggtaacaaccgacataagcgagatgggcgcgaactttaaagccgaccgggtaatcgacccccggcgctgcctgaagcccgtaatcctgaccgatggccctgagcgggtgatcctcgcgggaccgatgcctgtcacggccgcctccgcagcacagcggaggggccgcgttgggcggaacccccaaaaggaaaatgatcagtacatattcaccgggcagcccctcaacaacgacgaggaccacgcccattggaccgaggccaagatgctgctagacaacatcaacacaccggaggggataatccccgccctgttcgagcccgaacgtgagaagtccgcggcaatcgacggcgaatacagactcaaaggtgagtccaggaagacctttgtcgagctaatgagacgcggggacctgcccgtgtggcttgcccacaaagtcgcctccgagggcattaagtatacagaccggaagtggtgcttcgacggggagcgcaataaccagatcctagaggagaacatggatgtagagatctggacgaaggagggcgagcggaagaaactgcgcccgcgatggctggacgcgcggacctactccgatcctctcgccctaaaggagttcaaggacttcgccgccgggaggaaaagcatcgccctggacctcgtgactgaaatcgggcgggtgccctcccatcttgcccaccgcacgcgaaatgcccttgataacctcgttatgctccacacatccgaacacggcggcagagcctaccggcatgctgtggaggagctgccggagacaatggagacgcttctgctgctcggcctgatgatcctgttgaccggcggggctatgctgttcctgataagcgggaaggggataggcaagacttcaatagggctcatctgcgtcatagtaagttccggcatgctttggatggcggatgtgcccctgcagtggatcgccagcgccatcgtgctcgagttcttcatgatggtcctcctgatccccgagccggagaagcagcgcaccccgcaggacaaccaactcgcctacgtggtgatcgggatcctgaccctggccgcgatcgtcgcggccaatgagatgggactcttagagacaaccaagcgggacctggggatgtccaaggagcccggagtcgtgagtcccacctcgtacctcgatgtcgacctgcaccccgctagcgcctggaccctgtacgcggtggccacgaccgttatcactccgatgctccgccataccatcgagaactccacagccaacgtctccttagccgcgatcgccaaccaggccgtggttctaatgggcctcgacaaaggctggcccatctccaagatggacctgggtgtacccctgctcgccctggggtgctatagccaggtgaaccccctgaccctcaccgccgcggtgcttctgctcgtaacccactacgccatcatcggcccgggcttacaggccaaggccacgcgggaggctcagaaacgcaccgcggccggtatcatgaagaaccccaccgtggatggtatcatgaccatcgacctggacccggtgatctacgactccaagttcgaaaagcagttaggccaggtcatgctgctcgtgctctgcgccgtgcagctattactcatgcggactagctgggccctatgcgaggctctgaccctcgcgaccggccccatcaccacactgtgggagggctccccggggaagttttggaataccaccatcgccgtcagcatggccaacatattccgaggatcgtacctcgccggtgcaggcctcgccttcagcatcatgaagtccgtggggaccgggcgtaggggcactgggagccagggcgagacgctgggtgagaagtggaaaaagaagctcaatcagctcagccggaaggagttcgacctgtataagaagtccggcatcacggaggttgaccgcacagaagcaaaggaagggctgaagcggggcgaaaccacccaccacgctgtctcgcgcggatccgccaagctccagtggtttgtggagcggaacatggtgatccccgaggggcgcgtcatcgacctaggctgcgggcgcggcgggtggagctattactgcgcaggcctgaagaaggtcacagaggtgagaggctatacaaagggcggccccgggcacgaggagccagtcccaatgtccacatacggctggaacatcgtgaagctcatgagcggaaaggacgtgttctatctgccacccgaaaagtgcgacacgctcctgtgcgacattggcgagtcatccccctccccgaccgtcgaggagagccgcacaatccgggtgctcaaaatggtggagccgtggctccgcaacaaccagttttgcatcaaagtcctgaacccctacatgcccaccgtcatcgagcatctcgagcgtctacagagaaagtacggcgggatgttagtgcggaacccgctctcccgtaactccacgcacgaaatgtactggatttccaacggcaccgggaacatcgtttcctccgtcaacatggtcagtcggctgctgttaaaccgctttaccatgacccaccgtcgccctacgatcgaaaaggatgtggacctgggcgccggcacccggcacgtgaacgcggagcccgagacaccgaatatggatgtcataggggagagaatcaagcggatcaaggaggagcactccagcacctggcattacgacgacgagaacccctacaaaacgtgggcgtaccacggctcctacgaggtgaaggcgaccgggagcgcgagctccatgatcaatggcgttgtcaaactgctgaccaaaccctgggacgtggtgccgatggtcacccagatggccatgactgataccaccccgttcgggcaacagcgtgtcttcaaggagaaggtggacacccgtacaccccgccccatgcccggcactcggaaagtcatggagatcaccgccgagtggctgtggcgtaccctgggccgcaacaagaagccgcggctttgcacgagagaagagttcacgaagaaggtgcggacgaacgccgccatgggtgcggtgttcacagaggagaaccagtgggatagtgcccgcgccgccgtcgaggacgaggagttctggaaactggtggacaaggagcgggagctccacaaactcggcaagtgcgggtcctgcgtgtacaacatgatgggtaagcgcgagaaaaagttaggggaatttggcaaggctaagggcagccgggccatatggtacatgtggctgggggcccgctacttggagttcgaagctctgggattcctgaacgaggaccactggttctcccgagagaatagctactctggggtcgagggcgaggggctgcacaagttaggctatatcctgcgcgacataagcaagatccccggaggggcgatgtacgctgacgacacggccggatgggacacacggatcaccgaggatgacttgcacaacgaggagaagatcacccaacagatggatcccgggcatcggcagctggccaacgccatcttcaagctgacgtaccagaacaaagttgtgaaggtccagcgcccgacgccgaagggtaccgtgatggacataatctcccggaaggaccagcggggcagcggccaggtgggcacctatgggctaaacacctttactaacatggaggcacagctagtccgccagatggagggcgagggggtgcttagcaaagcggacctagaaaacccccacctcctggaaaagaagatcactcagtggctcgaaacgaagggcgtggagaggcttaaacgcatggccatcagcggagacgactgcgtagtgaagcccatcgatgaccggttcgccaacgccctgctcgccctgaacgatatggggaaggtgcgcaaggacatcccgcagtggcagccctcaaagggctggcacgactggcagcaagtccccttttgctcccaccactttcatgagctgatcatgaaagacgggcggaagctcgtggtgccgtgccgcccccaggacgagctgataggccgcgcgcggatctcccagggggccggctggagcctgaaggagaccgcctgtctcggcaaggcatatgcccagatgtggagtctgatgtacttccaccgccgggatctgcgcctcgcgagcaatgcaatatgctccgccgtccccgtgcattggatccccacaagccggaccacctggagcatccatgcccaccaccagtggatgacgacggaggacatgctgaccgtatggaaccgcgtgtggatcgaggacaacccatggatggaggataagacccccgttacaacgtgggaggacgtgccgtacctaggtaagcgggaggaccagtggtgcggttccctcatcgggctgaccagccgcgccacctgggcccagaacatcctgaccgcgatccagcaggtccggtcccttatcggcgacgaggagttcctcgattacatgcccagcatgaagcgctttcggaaagaagaggagacggagggtgccatctggtga

SEQ ID NO: 26202 - RNA, 9873 nt, synthetic construct
  misc_feature 1..9873: note = derived and/or modified CDS sequence (opt11) from DENV-3__EF643017__SS-prME
  source 1..9873: mol_type = other RNA
accagtctgtgcctcatgatgattctgcccgcggccttggcgtttcacttgacctcgcgagatggggagcctcggatgatcgtggggaagaacgagcgcggtaagtcgttgctgtttaagaccgccagcgggattaatatgtgtaccctcatcgccatggatctgggcgagatgtgtgacgacaccgtcacctacaagtgcccccacatcaccgaagtggaacccgaggacatagactgctggtgcaacctgacctctacctgggtgacatacggcacgtgcaaccaggccggggagcgccggcgggacaagcgcagcgttgccctcgctccccacgtgggcatggggttggacacccggacccagacctggatgagcgccgagggcgcctggcgtcaggtggagaaggtcgaaacgtgggcactgcggcacccggggtttaccatcttagctttatttctcgctcactacatcggcacctccctcactcagaaggtcgtgatctttatcctgctgatgctcgtcaccccgagcatgaccatgcgctgcgtgggggtgggtaatcgagacttcgttgaagggttatccggggcgacttgggtcgacgtcgtcttagagcacggtgggtgcgtgacgacgatggccaagaacaagcccacattagacatcgagctgcagaagactgaggccacccagctggctacgctccgcaagctgtgcatcgagggcaagataaccaatataacaactgattctaggtgccccacgcagggagaagccgtgttgccagaggagcaggaccagaactacgtctgcaagcacacctatgtggaccgcgggtggggtaacgggtgcggcctcttcggcaaaggctccctggtgacctgtgccaagttccagtgcctggagcccatcgaaggcaaggtcgtgcagtacgagaacctcaagtatacggtcatcatcactgtccatacgggagaccagcatcaggtgggcaacgagacccagggggtaaccgccgagatcactccccaagctagcaccacggaggctatcctgccggagtacggcaccttagggctcgagtgcagcccgcgtactggcctggacttcaacgagatgatcctgctaacgatgaagaacaaggcatggatggtgcacaggcagtggttctttgatctgccccttccctggaccagcggcgccacaaccgagacgcccacctggaaccggaaagagctcctggtgacattcaaaaacgctcacgcaaagaaacaggaagtcgtggtgctggggtcccaggagggcgcaatgcacaccgctttgacgggggcaaccgagatccagaacagtggcggcacctcgatcttcagcggccacctgaagtgccgcctgaagatggacaagctcgagctgaagggcatgtcctacgccatgtgcaccaatacgttcgtcctgaagaaggaggtgtcagaaacccaacacgggacgatcctcatcaaggtagagtatcggggcgaggacgcgccttgcaagatccccttcagcaccgaagacgggcaaggcaaagcgcacaacggccgcctgatcacggccaaccccgttgtgacgaagaaggaggagcccgtgaacattgaggccgagccgcccttcggggagtccaatatcgtcatcggcatcggggacaacgccctgaagataaactggtacaagaaggggagcagcattgggaagatgttcgaggcgaccgcacgaggagcccgtcgcatggccatcttaggtgacacagcctgggacttcgggagcgtgggcggggtgctcaactcactgggcaagatggtccatcagatcttcgggagcgcgtacacggccctgttcagtggcgtaagctgggtcatgaaaatcggcatcggggtcctcttgacctggatcgggctgaactccaaaaatactagcatgtcctttagctgcattgccatagggatcatcaccctctacctgggcgcagtggttcaggcggacatggggtgcgtaataaactggaaaggcaaggagctgaagtgcggctccgggattttcgtgactaacgaggtgcacacctggaccgagcagtacaagtttcaggctgacagccccaagcggctcgcgaccgccatagccggcgcctgggagaacggggtttgcggcatccgctccacgacacggatggagaacctgctgtggaaacagatcgcgaacgagttaaactacatcctgtgggagaataacattaagctaaccgttgtggtcggggacatcataggcgtgctcgaacagggcaagagaacccttacgccccagccgatggaactgaagtacagctggaagacctggggaaaggccaagatagtgaccgccgaaacccaaaattcgtccttcattatagatggccccaacacccccgaatgccccagcgccagcagggcctggaacgtctgggaggttgaggactacgggttcggcgtgttcaccaccaacatatggctcaagctgagagaggtctacacacagctgtgtgaccaccgacttatgagcgccgccgtgaaggacgaacgagccgtgcacgccgacatgggctactggatcgagtcccaaaagaatgggtcttggaagctggagaaggcgtccctgatcgaggttaaaacctgtacgtggcccaagtcccacaccctctggtccaacggggtgctggagagcgacatgatcacgcccaagtccctggccgggcctatttcacagcacaaccaccggccgggctatcacacccagacggccgggccctggcacctcggcaagctggagctcgacttcaactactgtgagggtaccacggtggtcataaccgagaactgcgggacgcgaggcccctccctcaggacaacaacggtcagtgggaaactgatccatgagtggtgctgcagatcctgcacgctgcccccgctccggtacatgggcgaagacgggtgctggtacggcatggagatccgtccaattagcgagaaggaggaaaacatggtaaagtccctggtaagcgctggctccggcaaggttgacaactttaccatgggggttctgtgtttagccatcctctttgaggaggtcatgcgggggaagttcggcaagaagcacatgatcgcgggggtgttcttcacctttgtgctactcctgagcggccaaataacctggcgcgacatgacacacaccttgatcatgatcggctccaacgccagcgatagaatggggatgggcgtcacctacctcgccctgatcgcaacgttcaagatacagcccttcctggccctcgggttctttctgcgcaaactgacgagccgggagaaccttctcctgggcgtgggcctcgcgatggcgaccacactgcagctgcccgaggacatcgagcaaatggccaacggcatcgccctcggcctgatggcgctcaaactcatcacacagttcgagacgtaccagctgtggaccgccctgatctcgctgacctgcagcaacacgatgttcaccctgactgtcgcttggcgcaccgccaccctgatcctcgctggagtctccctgctaccagtgtgtcagagctcctctatgcgcaaaacggactggctcccaatggcggtagcggccatgggcgtgagccccctccccctctttatcttcagcctcaaggacaccctgaagcgccgctcctggccgctgaacgagggggtgatggcagtcggcctcgtgagcatcctggcctccagcctgctcaggaatgacgtccccatggctggccctctggtcgccgggggcctgctcatcgcctgctacgtaatcaccgggacttccgccgacctgacggtggagaaggccgcggatataacccgcgaggaggaggcagagcaaactggtgtcagccacaacctaatgaccaccgtggacgatgacggaactatgcggattaaggacgatgagaccgagaatatcttgaccgtgttactgaagacagcattactgatcgtaagtggcgtatttccctacagcatcccggccacgctgctcgtgtggcatacttggcagaaacagacccagcgctccggcgttctctgggacgtgccctccccgcccgagacccagaaggccgagctagaggagggggtgtaccggattaagcagcaaggcatcttcgggaaaactcaggtcggcgtgggggtgcagaaagagggcgtcttccacaccatgtggcacgtgaccagaggggcggtgctcacatacaacgggaaacggctggagccgaactgggcctccgtgaaaaaggacctgatctcgtacggcgggggatggcgcctcagcgcccagtggcagaagggggaggaggtccaggtgatagctgtcgagcccggcaagaaccctaagaacttccaaacgatgcctggcacctttcagacgaccaccggggagattggtgcgattgccctggacttcaagccggggacgtctggttctcccatcatcaaccgggagggcaaggtggtggggctatacggtaacggagtcgtcaccaagaacggcgggtacgtgagtggcatcgcccagaccaatgccgagcccgacggtccgacgccggaactggaggaggagatgtttaagaagcgtaatctcaccatcatggacctgcaccccggtagcggcaaaaccaggaagtacctgcccgccatcgtcagggaggcaatcaagcggcgccttcggaccctgatcctggccccgactcgcgttgtcgccgccgagatggaggaggcccttaaggggctgcccattcgttaccagacaacagcgactaagtccgagcacacggggcgcgagatcgtcgacctgatgtgccacgccaccttcaccatgcggctcctgagcccagtgcgcgtgccaaactataacctgataataatggatgaggcccacttcaccgacccggcctccatagccgcgcgggggtacatctctacgcgagtgggcatgggcgaagctgcagctatcttcatgaccgcgacgccgccgggtaccgccgacgccttcccccaatccaacgccccgatccaggacgaggagcgcgacatacccgaacggagctggaactccggcaacgagtggatcacggactttgccgggaagacagtgtggttcgtgcctagcatcaaggcgggcaacgacatcgctaactgcttacgcaagaacgggaagaaggtcatccagttatcccggaagaccttcgacactgagtaccagaagaccaaacttaacgactgggacttcgtcgtaaccaccgacatttcggagatgggcgccaacttcaaagccgacagggttatcgatccccggcgctgtttaaagccggtgatcctgaccgacggccccgagcgggtgatcctggcagggccaatgcccgttaccgccgcctcggccgctcagcggcggggccgcgtcgggcggaacccgcagaaggagaacgaccagtacatctttacgggacagcccctcaacaacgacgaggaccacgcacactggaccgaagcgaagatgctcctggacaacatcaacaccccggagggaatcatacccgcgcttttcgagccggaacgcgagaaatccgccgccatcgacggcgagtaccgtctgaagggcgagtcccgcaaaaccttcgtggagctcatgcgaagaggggacctcccggtctggctcgcgcacaaggtggccagcgaaggcatcaagtatacggatcggaagtggtgtttcgacgggcagcgcaacaaccagatcctagaagagaacatggacgtagagatctggaccaaagaaggagaaaagaagaagctccgccccaggtggctggacgcccgcacatactccgacccactggccctcaaagagtttaaggacttcgccgcgggccgcaaaagcattgcattggacctggtgacggagatcgggcgcgttcccagccacttagcccaccggacgcgaaacgcgctggataacctggtcatgctgcacacgtccgagcacggcggtcgggcctatcgccacgccgtggaggagctgcccgagacaatggagactcttctcctgctgggcctaatgatcctacttaccggcggggccatgctgttcttaatcagcgggaaggggatcggaaagacctccatcgggctaatttgcgtcatagccagctccggaatgagctggatggcagagatccccctccaatggatagcctccgcgatagtcttagagttcttcatgatggtactgctcatccctgagcccgagaagcaacggacgccccaggataaccaactggcctacgtggtaatagggatcctgaccctcgctgccatcattgcggccaacgagatgggcctcctagaaaccacgaagcgagatctcgggatgagcaaagagcccggggtggtgtctcctacaagctacttagacgtcgacctgcatcccgcctcggcctggactctttacgccgtcgcgacgaccgtgatcacccccatgttgcggcacaccatcgagaactccacggcgaacgtttctctggccgctatcgccaatcaagctgtcgtgctaatgggtctggataagggttggcccatcagcaagatggacctgggcgtgccgctcctggcccttgggtgctacagccaggtgaacccactcaccttaaccgccgccgtgctgttactgatcacacactacgccatcatcggtcccggcttgcaggctaaagccacgcgcgaggcccagaagcggactgccgccggcatcatgaagaatcccaccgtcgatggcatcatgacaatcgacctagacccggtgatctacgactcgaaattcgagaaacaactgggccaggtgatgctgctcgttctatgtgcggtgcagcttctcctcatgcggacgtcctgggctctgtgcgaagccctcacgctcgcgaccggtcccatcaccacactttgggagggcagccccgggaagttttggaacaccaccatcgcggtgtccatggccaacatcttccggggcagctacctcgccggggtcgggctggccttcagcatcatgaaatccgtgggaaccggaaagcgcggcacgggtagccaaggcgagactctgggggaaaagtggaagaagaaactcaaccagctgtcccgaaaagagttcgacctgtacaagaagtccggcatcaccgaggtagaccgtaccgaggccaaggaggggctcaagcggggcgaaatcacccaccatgcggtctcccggggcagcgccaagctgcaatggttcgtggaacggaacatggtaatccccgagggacgcgtcatcgacttaggctgcggtcgcggcggatggtcctactactgcgccggcctcaagaaagtgactgaggtgcgtggctacaccaaaggcggtccggggcacgaggagcccgtgcccatgtcaacctatggttggaacattgttaagttaatgtccgggaaggacgtattctatctgccgccggagaagtgcgacaccttactatgtgacatcggagaatcctcgccctctcccaccgtcgaggagtcccgcaccatccgggttttaaaaatggtggagccctggttgaagaacaaccagttctgtatcaaggtcctcaacccgtacatgcccacagtaatcgagcacctggaacgcctgcagaggaaacatggcgggatgcttgtgcgcaatcccctgagcagaaactccacccacgagatgtattggatcagcaacggcacagggaacatagtagcctccgtgaacatggtgagccgcctgctcctgaatcggttcactatgacccatcgtcggccgacaatcgagaaggacgtggatctgggcgccggcactaggcacgtgaatgcggagccagagacacccaacatggacgtaattggagaacgcatcaagcgcatcaaagaagaacacaactcaacctggcactatgacgacgagaatccctacaagacgtgggcctaccacggaagctacgaggttaaggccaccgggtctgcatccagtatgatcaacggcgtggtcaagctcctgacaaaaccgtgggacgtggtgcccatggtcacccaaatggcaatgaccgatacgacccccttcgggcaacaaagggtgtttaaggagaaagtggacacccgcacaccacggtcaatgcccggcacgcgccgggtcatgggtatcacagcggagtggctgtggcgcacactggggcgcaacaagaagcctagactgtgtacgcgcgaggagtttactaagaaagttcggactaacgccgccatgggcgctgtattcaccgaggaaaaccagtgggatagcgcgaaagccgccgtagaggatgaggacttctggaagctggtggaccgagaacgggaactccacaagctggggaagtgcgggtcctgcgtctacaacatgatggggaaacgcgagaagaagctcggcgagttcggtaaggctaaaggatcccgcgccatctggtacatgtggctgggcgcgcgctacctggagtttgaggccctgggtttcctcaacgaagaccactggttctcccgggaaaattcatactccggcgtcgaaggagagggcctgcacaagctgggctacatcctccgcgacattagcaagattcccggaggcgcaatgtacgccgacgacaccgcagggtgggacacccggatcaccgaggacgacctgcacaacgaagagaagataacccagcaaatggaccccgagcaccgccaactggcgaatgccatcttcaagctcacctaccagaacaaggtggtgaaggtccagcggcctacacccacgggcaccgtgatggacatcatctcccggaaggaccagcggggttcgggccaggtgggcacctacggcctaaacactttcacgaacatggaggcccagctgatccgccagatggagggcgagggggtcctctccaaggccgacctggagaacccccatctccccgaaaagaaaatcacacagtggttagaaaccaagggcgtggagcggctgaagcgtatggccatcagcggggacgactgtgtggtcaagccgatcgacgaccgtttcgcgaacgcccttttagctctgaacgataccgggaaggtgcgcaaggatatcccccagtggcagccctccaaaggctggcacgactggcaacaagtccccttttgttctcatcacttccacgagttgatcatgaaggatgggcggaaactcgtcgtaccgtgccgcccgcaggacgagctgatcggccgcgcccgaatctcccagggggccgggtggagcttgcgtgagacggcatgcctcggcaaggcctacgcacagatgtggtccctgatgtacttccaccggcgagacctgcggctcgccagcaatgcgatttgcagcgccgtgcccgtccattgggtacccacctctcgcaccacctggagcatccacgctcaccaccaatggatgacaaccgaggacatgctaaccgtatggaaccgggtctggatcgaggacaacccgtggatggaggacaagacccccgtgacgacatgggagaacgtgccctacctggggaagcgcgaggaccagtggtgtggctcattaatcgggttgaccagccgggccacctgggcccagaatatccctacagcgatccagcaggtccgctccctgataggcaacgaggagttcctcgactacatgccaagcatgaaacggttccgcaaggaggaggagagtgagggggccatctggtga

SEQ ID NO: 26203 - RNA, 9873 nt, synthetic construct
  misc_feature 1..9873: note = derived and/or modified CDS sequence (opt11) from DENV-3__DQ675519__SS-prME
  source 1..9873: mol_type = other RNA
acctccatctgcctgatgatgatgctccccgcaaccctggcgttccacctgaccagcagggatggcgagccccgtatgattgtgggtaagaacgaacgcgggaagagcctcctgttcaaaaccgcctccggcatcaacatgtgcaccctgatcgcgatggatctcggcgagatgtgcgacgacacagtgacctataagtgtcctctgatcaccgaggtagagcccgaggacatcgactgctggtgcaaccttaccagcacctgggtaacatatggcacctgcaatcaggcgggcgagcaccggcgagacaagcgttcggtggccctggcgccccacgtgggcatggggctggatacccgaacacagacttggatgagcgcggaaggcgcctggagacaagtcgagaaggtagagacctgggccttccgccatccggggttcacaatcctagccctgttccttgcgcactacatcggaacctccctgacacagaaggtggtgatctttatcctcttgatgctggtgacacccagcatgaccatgcggtgcgtcggggtaggcaatagagacttcgtcgagggcctctccggtgctacctgggtggacgttgtcctggaacacggcgggtgcgtaaccaccatggctaagaacaagcccacgctagacatcgaacttcaaaagacggaggccacgcagctggccacgctgcgaaagttatgcatcgaaggtaaaatcaccaacgtgactaccgacagccgctgtcccacccagggtgaagcgatcctgccggaggaacaggaccagaactacgtgtgcaagcacacctacgtggaccgggggtgggggaacgggtgtggcctattcgggaaaggttcgctcgtcacctgtgcgaagtttcagtgcctggagagcatcgagggtaaggttgtgcagcatgagaacctgaagtatacggtgataatcacggtccatacgggagaccagcaccaggtgggcaacgagacgcagggggtaactgctgaaatcacgccccaggcttctaccgttgaggccatcctacctgagtacggaaccctggggctggagtgcagtcctcgaacaggcctcgacttcaacgaaatgatcctactgacgatgaagaataaagcgtggatggtacaccggcagtggttcttcgacctccctctgccctggacgtccggagccaccactgagacgccgacctggaacaagaaggagcttctcgtcacgttcaagaacgcccacgccaaaaaacaggaggtggtagtcttagggagccaggaaggcgctatgcacaccgcgcttaccggggccaccgagatccagacctccggaggaactagcatatttgctggccatcttaagtgccgcctgaagatggacaagctggagcttaagggcatgtcctacgcgatgtgtttaaacgctttcgtgctgaagaaagaagtgtctgagactcaacatggtaccatcctcatcaaggtggagtacaagggtgaggacgcgccctgccggatcccgttcagcaccgaggacgggcagggcaaagcccacaacggacgccttatcaccgccaacccagtcgtgacgaagaaggaggagccagtcaacatcgaggcggagcctccgttcggggagtccaacatcgtgatcggcatcggggacaaggcgctgaagatcaactggtacaagaagggcagcagtatcgggaagatgttcgaggcaaccgcccggggtgcccgccggatggccatcctcggtgatactgcatgggacttcggaagcgttggaggggtgctcaattccctgggcaagatggttcatcagatctttgggtccgcctacacagcactcttttccggtgtgtcatggatcatgaaaatcggcatcggggtcctcctgacgtggattggactgaactccaagaacaccagcatgtcattcagctgcatcgtgatagggatcataaccctctacctgggcgcagtagtccaggccgatatgggctgcgtgatcaattggaaggggaaggagttaaagtgcggcaacgggatcttcgtaaccaacgaggttcatacttggaccgagcagtacaagttccaggcggactcgcccaagagactggccactgccatcgccggcgcgtgggagaacggggtttgcgggatccgctcgactacgcggatggagaacttactctggaagcagatcgctaacgagctcaattacattctgtgggagaacaacatcaagttgacggtggtcgttggagacatcattggcgtgctcgagcagggcaagaggacccttactccccagcccatggaattaaagtactcctggaagacgtgggggaaagccaagatagtaacggctgagacccagaacagtagcttcataatcgacggtccgaacacacccgagtgccccagtgccagtagagcgtggaatgtgtgggaggtggaggactacgggttcggggtctttacgaccaacatctggctcaagctgcgcgaagtgtacacccaactctgcgaccaccggctgatgagcgcggccgtgaaggacgaacgcgccgttcacgcggatatgggctactggatagagtcacagaagaacgggtcctggaagctcgaaaaggcgtcactgatagaagtgaagacctgcacttggccgaaatcccatactttatggtcaaacggcgtgttggaatccgacatgattatcccaaagtcgctcgccgggcctatatcccagcacaaccaccggcccggctaccatacccagacagcggggccgtggcacctcgggaagctggaactggactttaactattgtgagggtaccacggtggtgatcaccgagaactgcgggacccgcggcccctcgcttcgcaccaccaccgtgtccggtaagttaatccacgagtggtgctgtcgcagctgcaccctaccgcccctccggtacatgggcgaagacggatgctggtacggcatggaaatccgcccgatcaacgaaaaggaggagaacatggtcaagtccctggtcagcgcgggctccggaaaggtggataacttcactatgggcgtcctttgcctcgccattctgttcgaagaggtcatgcgggggaagttcggaaagaagcacatgatagcgggggtcttattcacgttcgtgctcctgctgagcgggcaaatcacctggcgcgacatggcacacaccttgatcatgatcggctccaacgccagcgaccggatggggatgggagtgacgtacctggccttgatcgccactttcaagatacagcccttcttggccctgggattcttcctgagaaagctcacgtcacgggagaacttactgctcggtgtgggccttgcgatggcgaccaccctgcagcttcccgaggacatcgagcagatggccaacggggtcgcgctgggcctaatggccctaaagcttataacacagttcgagacctaccagttatggaccgccctcgtgagcttgatgtgcagcaacactatatttacgctgaccgtcgcttggcgcaccgcaacattgatcctggcgggcatatccttgctcccggtctgccagagctccagcatgcggaagacggattggcttccgatgactgtggcggccatgggcgtgccgcctctgccactcttcatcttctccctgaaagataccctgaagcgtcgcagttggccgctcaacgaaggggtcatggctatcggtctggtatccatcctggcctcgtccctactgcggaacgacgtacccatggcgggcccgctcgtcgccgggggcctcctgatcgcctgttacgtgatcactgggacgtcggccgacctgaccgtcgaaaaggccgcggacgtgacttgggaggaggaggccgaacagaccggcgtgtcccacaacctcatgatcaccgtcgacgacgatgggacgatgcgcataaaggacgacgagaccgaaaacattctaaccgtcctgttgaagaccgccctactgatcgtttcaggtatcttcccctactccataccggccacgctcctggtctggcatacatggcagaagcagacccagcggtctggcgtgctatgggacgtgcctagcccgccggagacccagaaggctgagctagaggagggggtttaccgcatcaagcagcaaggtatcttcgggaaaacacaggttggcgtaggtatccagaaagagggcgtcttccataccatgtggcatgtgacccggggcgcggtgctgacccataacgggaagcgcctggagccgaactgggcctcggtcaaaaaggaccttattagttacggcggggggtggcggttgagcgcacagtggcaaaagggggaggaggtccaggtgatcgcagtcgagcctggtaaaaaccccaagaactttcagacgatgcccggcatattccagacgaccaccggggagatcggcgcgatagctctggacttcaagccggggacatccggatcacccataataaacagagagggtaaggtggtggggctctacggtaacggcgtcgttacaaaaaacggcggatacgtgagcggtatcgcccagaccaacgcggagcccgacggcccgacccccgaactagaggaggagatgttcaagaagcgtaatctaactatcatggacctgcaccccgggtccggcaaaaccagaaagtacttaccgaccatagtgagggaggctatcaagcggcggctgcgcactctgatactcgcgcctacgcgggtagtggccgccgagatggaggaggctctgaaggggttaccaattcgctaccagaccaccgctactaaaagcgagcatacgggaaaggagatcgtcgacctcatgtgtcacgcgaccttcacaatgcgcctgctgtcccccgtgcgcgtgccaaactacaacctgatcatcatggacgaggcccacttcactgatccggcctctatcgcagcccgggggtatatcagcacgcgagttggaatgggagaggccgccgccattttcatgaccgccactccgcctgggaccgcggacgctttcccccaaagcaacgccccgatacaggacgaggaacgggacatcccagagcgctcctggaacagcggcaacgagtggatcacggacttcgtaggaaagaccgtttggttcgtcccctcgatcaaggccggcaacgacatcgctaactgcctccgcaagaacgggaagaaggtgatccaactgagccggaagacattcgacacagagtaccaaaagactaagctcaacgactgggatttcgtggtcaccaccgacatttccgagatgggagcgaattttaaggccgacagggtgatagacccccggcgttgcttgaagccggtgatcttgaccgatggccccgaaagagtcatcctcgctgggccaatgcccgtaacggtggccagcgcagcgcagcgccggggcagagtcgggcggaacccccagaaagagaacgaccagtacatatttactggccagccgctgaacaatgacgaggatcacgctcactggaccgaggccaagatgttactagataatatcaacacccccgaggggatcatccccgccctgttcgagccggagcgtgagaaaagtgccgcgatcgacggcgaatacagactgaagggcgaatcacgcaagaccttcgtggagctcatgcggcgtggggatctacccgtttggctggcgcataaggtggcctcagagggcatcaagtatacggaccggaaatggtgcttcgacggcgagcggaacaaccagatcttggaggagaacatggacgttgagatctggacgaaggagggtgagaagaagaagctgcggccccgatggctggacgcccggacttatagcgatcccttagcccttaaagagtttaaagacttcgccgccggaagaaagtctatcgcgctggacttggtaacagagatcggacgcgtgccgagccacctggcgtatcggacgaggtccgcgctggacaatctcgtcatgctacacaccagcgagcacggaggccgggcgtaccgccatgcagtagaagaactgcccgagaccatggagaccctcctgcttttaggattgatgatcctgcttacaggtggggccatgttgttcctgataagcggcaaggggattggaaaaacatccatcggcctcatctgcgtggtggcatcgtctggcatgctgtggatggctgacgtcccactgcagtggatcgccagcgccattgtgctcgagttcttcatgatggtcctgctgatcccagagcccgagaagcagagaacaccccaagacaaccagctcgcctatgtcgtgatcggcatcctgaccctggccgcaattgtagccgcaaacgagatgggcctcttggagacgacgaaacgggacctgggcatgtccaaggagccaggggtcgtgagcccgacctcctatctcgatgtagatctgcaccccgccagcgcctggacactgtatgcggttgccacgaccgtaatcacacccatgctccggcacaccatagagaactcaaccgccaatgtgagcttagccgcaatcgccaaccaagccgtagtgctgatgggtctcgacaaggggtggcccatctccaagatggatctgggcgtccccctgctcgcactgggatgctacagccaggtaaaccctctgaccttaaccgccgcggtactgctcctcgtgacgcactacgctattatcggacccggcttgcaggccaaggccacgcgagaagcccagaagcggacagcggcagggattatgaagaaccccaccgtcgatggcatcatgaccatagacctagacccggtaatctatgacagtaagttcgagaagcagctcggccaggtgatgttattagtactctgtgccgtgcagctgttactaatgcgcacctcatgggccttctgcgaggcactgaccctcgcgaccggcccaatcacaacgttgtgggaaggctcccccgggaagttttggaacacgaccattgctgtgtccatggcaaacatcttccgtggctcctacctggccggcgccggcctggccttcagtatcatgaagtccgtggggaccggcaaaaggggcaccggtagccagggagagactctcggggagaagtggaaaaagaagctgaatcagctgagccggaaggagtttgacctctacaagaagtccggcatcactgaggttgaccgcaccaaggccaaggaaggactcaagcggggcgagaccacgcatcacgccgtgagcagagggtctgccaagctgcagtggttcgtcgaaaggaacatggtgattcccgaggggcgggtgattgacttaggttgcgggcggggcgggtggagctactactgcgcggggctgaagaaggttaccgaggtgcgcggctacaccaagggcggacccggtcacgaggagcccgtgccaatgtccacctatggctggaatatcgtcaagctgatgtcaggaaaggacgtattctacctcccgcccgagaaatgcgacaccttactgtgcgacattggcgagagcagcccctcgcccaccgtagaggagagccggaccattcgcgtcttgaagatggtggagccctggctcaagaataaccagttctgtatcaaggtgctgaacccatacatgcccacagtcatcgagcacctcgagcgcctccagcgcaaacacggtgggatgttggtgcgcaaccccctgtcccggaacagcacgcacgaaatgtactggatttccaacggcaccgggaacatagtgagctccgtcaacatggttagccgcttactcctgaaccgattcactatgacccacaggcgacccactatcgagaaggatgttgacctcggcgccggtacccgccacgtcaatgccgagcctgaaacccccaacatggacgtcatcggggagcgtatccgccgtattaaagaggaacactcctccacatggcactatgacgacgagaacccatataagacgtgggcataccacggctcatatgaggtaaaagccacggggtctgcgagctccatgattaacggcgtggtcaagttactgaccaagccgtgggacgtcgtgcccaccgtaactcagatggctatgaccgacaccacccccttcgggcagcagcgcgtattcaaggagaaggtggatacgcgaacgccccgccctatgcccggaacccggaaggtcatggaaatcaccgccgagtggctatggcgcaccctgggtcgaaataagcgcccgcgtctgtgcacacgcgaagagttcaccaagaaggtccgcaccaacgctgccatgggggcagtgttcacggaagagaatcagtgggatagcgcacgggccgcggtggaggacgaagagttctggaagcttgtcgaccgtgagcgggaactgcacaaactgggcaagtgcgggtcctgcgtgtacaacatgatgggcaagagagagaagaaactcggggagtttgggaaggcgaagggctctcgggcgatatggtatatgtggttaggggcccggtacctggagtttgaagccctcggcttcctgaatgaggaccactggttctcaagagagaacagctactcaggcgtggaaggcgaggggctccacaagttagggtacatattacgcgacatcagcaagacacccggaggggccatgtacgcggacgataccgccggctgggatactcggatcacggaggacgacctgcataacgaggagaagattacccagcagatggatcccgagcaccgccaactcgccaatgctattttcaaacttacctaccagaacaaggtcgtgaaggtgcagcggcccacacccaaagggaccgtcatggacatcatttcccgcaaggaccagaggggcagcggccaggttggtacatacgggctgaacacattcactaacatggaggcccaattgatccgccagatggagggggaaggcgtgctgtccaaagcggacctagagaacccccatctcccggagaagaaaatcacccaatggctggagacgaagggggtcgagcgactgaagcgcatggccatcagcggcgacgattgcgttgtgaaacccatcgacgaccggttcgccaacgccttactggccctgaacgacatgggcaaagttcgcaaggacatcccccagtggcaaccctccaaaggctggcacgactggcaacaggtgccgttttgctctcaccacttccacgagttaattatgaaagacggccggaagctggtggtaccctgtcgcccccaggacgagctgataggccgggcgcgaatctcccagggtgcggggtggagcttaaaggagaccgcctgcctgggcaaggcctacgcgcaaatgtggtccctgatgtacttccaccgccgggacctgcgcctggcgtcgaacgctatctgttcggctgtgccggtgcactgggtcccgaccagcagaaccacgtggtccatccacgcccatcaccagtggatgacaaccgaggacatgttaaccgtgtggaatcgcgtttggatcgaggacaacccctggatggaagacaagacccccgtaaccacttgggaggacgtgccctacctaggcaagcgggaggaccagtggtgcgggtctctgataggcctgacctctcgcgcaacgtgggcacagaacatcctcacagccatccagcaggtccggtccctgatcgggaacgaggagttcctggactacatgccgtccatgaagcgttttcggaaggaagaggaatccgagggcgccatctggtga

SEQ ID NO: 26204 - RNA, 9873 nt, synthetic construct
  misc_feature 1..9873: note = derived and/or modified CDS sequence (opt11) from DENV-3__DQ675521__SS-prME
  source 1..9873: mol_type = other RNA
accagcttttgtctgatgatgatgctccccgcgaccttagcgttccacctgacgtcccgggacggcgaaccgcggatgatcgtcgggaagaatgagcgaggcaagagcctcctcttcaagaccgcgtccgggatcaatatgtgcacgctgatcgccatggacctcggcgaaatgtgcgacgacacggtcacctataagtgccccctgattgccgaggtggagcctgaagacatcgattgctggtgcaatctgaccagcacgtgggtgacgtacggtacgtgcaaccaggccggcgagcaccggcgcgacaaacggagcgtcgccctcgccccacacgtgggcatggggctcgacacccgcacccaaacctggatgtctgccgagggcgcctggcggcaggtagagaaggtagagacgtgggcgctgcgccatcctgggttcaccattttagcgttattcctcgcccactacatcgggacttccctcacccagaaggtggtaattttcatcctgctaatgctagtgacgccaagcatgactatgcggtgtgtgggggttggcaaccgagacttcgttgaaggcctgtccggggccacttgggtggacgtggtcctggagcacggcggctgcgtgaccacgatggccaaaaacaagcccaccctcgatatcgagctgcagaagaccgaggctacacagttggcaacactccggaagttgtgcatcgagggcaagatcaccaacatcacaaccgatagccgttgccccacgcaaggcgaggccatcttgccggaggagcaggaccaaaactacgtgtgcaaacacacctacgtagaccgggggtggggcaacgggtgtggcctctttggcaagggcagcctggttacctgtgccaagttccagtgcttagagcccatcgagggtaaggtggtccaatacgagaacctcaaatacacggtgataataacggtgcacaccggggaccagcaccaggtcgggaacgacacccagggcgtcaccgttgagattacgccccaggcaagcaccgtggaggccgtactgccggaatacggcaccctcgggctcgagtgctccccgcgcaccgggttagatttcaacgaaatgattctgctcacaatgaagaacaaggcgtggatggttcaccggcagtggttcttcgatctgcccctgccctggacatctggggccacaaccgagactcccacgtggaaccgcaaagaacttctggttacattcaagaacgcccacgcaaagaagcaggaagtggtggtgctggggtcccaggagggggcaatgcacaccgctttgaccggtgccacggagatacagaatagcggcgggacctccatattcgccggacacctaaagtgtcggctgaagatggacaagctcgagctgaagggaatgagctacgccatgtgcctgaacaccttcgttctgaagaaggaggtgtccgagacccagcacggtacgattttaataaaggtggagtacaagggcgaggacgccccatgcaagatccccttcagcaccgaggatggtcagggcaaggcgcacaatggtcgactgatcacggccaatcccgtggtcaccaagaaggaagaacccgtgaacatcgaagccgagccacccttcggggagagcaatatcgtgatcggcatcggagataaggccctgaaaattaactggtataagaaaggcagcagcatcgggaagatgttcgaggcgacagcccggggcgcccggcggatggccatactcggcgacactgcctgggactttgggtccgtcggcggggtgctgaactcactgggcaagatggttcaccaaatcttcggaagcgcgtacaccgccctcttcagcggcgtatcctggatcatgaagatcgggatcggggtcctgctgacctggattgggctcaactcgaaaaacacgtccatgagtttctcttgcatagtcatcgggatcatcaccctgtacctgggcgccgttgtgcaagcggatatggggtgcgtgatcaactggaagggcaaggagctcaagtgcggcagcggtatcttcgtcacgaacgaggttcacacctggacggagcaatacaagttccaggccgactcacccaagcgtttagccaccgccatcgctggcgcctgggagaacggcgtgtgcggaatccgcagcacaacacggatggagaacctgctgtggaagcaaattgccaacgagctgaattacatcctgtgggagaacaacatcaaactcacggtcgttgtgggggacatcataggcgtcctggaacagggtaagcgcacccttacaccccagccgatggagctcaagtactcatggaagacctgggggaaggcgaagatagtgactgccgagatccagaacagtagcttcattatcgacggccccaacacacccgaatgccccagcgcctcacgggcatggaatgtctgggaggtcgaggactacgggttcggcgttttcacgaccaacatctggctgaagttacgcgaaatgtatacgcagtcctgcgaccaccggttaatgagcgcagccatcaaagacgaacgcgccgtgcacgccgacatggggtactggatcgagtcccagaagaacgggagctggaagctagaaaaggcatccttcatcgaggtcaagacctgcacgtggccgaagtctcacaccttatggtccaatggcgtgctcgagagcgacatgatcatcccgaagtccttggcagggcccatcagccagcataaccaccggccgggataccacacccaaacggccgggccctggcacctgggcaagctcgagctggattttaactactgcgagggtacaactgtcgtgattacggagaactgcgggacgcgcggcccctccctgcggaccaccaccgtatctgggaagctcatccacgagtggtgctgtcgctcctgtactttgcccccgttaaggtacatgggtgaggacggctgctggtacggcatggagatccgccccataaacgagaaggaggagaacatggtgaaaagcctcgtctcagccggcagtgggaaggtggacaatttcaccatgggcgtactgtgcctggccatcctcttcgaggaggtcatgcggggaaagttcggaaagaagcacatgatcgtgggggtactgttcaccttcgtcctgcttctgagcggccagatcacctggcgtgatatggcccacacgctcataatgatcggcagcaacgcgtcggaccggatgggaatgggcgtgacctaccttgccctgattgccacttttaaaatacagcccttcttagccctcgggttctttctgcgcaaactgaccagccgagagaacctactgctgggcgtgggcctcgccatggcgaccaccctgcaactgcccgaggatatcgaacagatggcaaatgggatcgccctcggcctgatgaccctgaagctcatcactcagttcgagacctatcagctgtggaccgccctggtaagcctaacctgctccaacactatcttcacacttaccgtggcttggcgcaccgcgaccctgatcctcgccggggtctcactgctgccgttgtgccagtccagcagtatgcgaaagaccgactggctaccaatgaccgtggcggccatgggggtgccccctttaccactcttcatcttcagcttaaaggacactcccaaacgccgctcctggcctctgaacgagggggtcatggcggtgggcctcgttagcattctggccagtagcctgctccggaacgatgtccctatggccggccccctggtggccggaggcctgctcattgcttgctacgtgatcaccgggacgtccgctgacctgaccgtggagaaggcggccgacgttacctgggaggaggaggccgagcagacgggcgtgagccacaacctgatgataacggtagacgatgacgggaccatgcgcatcaaagacgacgaaaccgaaaacatcctcactgtgttgctgaaaacagctctcctgatagtttctggcatcttcccttacagcatacccgcgacgctgctcgtctggcatacctggcaaaagcagacccagcggtccggcgtattgtgggatgtgcccagcccgcccgagacccagaaggccgagctggaggagggggtctatcgcatcaaacagcagggcatcttcgggaagacacaggtgggcgtgggggtccagaaagaaggggtgttccacaccatgtggcacgtcacccgcggcgctgtcctcacccacaacggaaagcggctggagcccaattgggcctccgtgaaaaaggacctaataagctatggcggagggtggcggctatccgcccaatggcagaagggggaggaggtacaggtcatagcggtggagcccggcaagaatccgaagaacttccagacgatgcccggcattttccagaccaccacaggcgagatcggggccatcgccctggacttcaagcccgggacctcggggagcccgatcataaaccgcgaggggaaggtggtcggtctttatggcaacggggtggttaccaagaacggcgggtacgtatctggcatcgcccagaccaacgcagagccagacggtcctactcccgagctggaggaggagatgtttaagaagcggaacctcacgattatggaccttcatcctgggagcggcaaaactcgcaaatacctacccgctattgtgcgggaagccatcaagcgcaggctccgcaccttgatcttggcccctactcgagtcgttgcggcggaaatggaggaggcactcaaggggctcccgatcaggtaccagacgaccgccaccaaatccgaacacaccggccgcgagatcgtggacctgatgtgccacgcaaccttcaccatgcgcctcctgagtcccgtgcgggtgcccaactacaaccttataattatggacgaggcgcacttcacggaccccgcttccatagccgctcgcgggtatatcagcaccagggtgggcatgggcgaggccgctgcgattttcatgacggccacacccccggggaccgccgaagccttcccccagtccaacgcgcccatacaggatgaggagcgtgacattcccgagcgcagctggaactcaggcaacgagtggatcaccgacttcgtcgggaagacggtttggtttgtcccgagcatcaaggccggtaatgatatcgcgaactgcctaaggaagaacggtaagaaagtgatccagctgtcccgaaagacattcgacacagagtaccagaagacccggctgaacgactgggactttgtcgtcaccaccgacatcagcgagatgggcgccaacttcagggccgaccgggtcatcgaccccagaaggtgcctcaagcccgtcatcctgaccgacggtcccgagcgtgtgatcctggcagggccgatgcccgtgaccgccgccagcgcggcacaacgccgtggtcgtgtcgggcggaacccacaaaaggagaacgaccaatacatcttcacgggccagcccctcaacaatgacgaggaccacgctcattggaccgaggctaagatgctgctggacaatatcaatacgccagaggggatcatacccgctctgttcgagcccgagcgagagaaaagcgcagccattgatggcgaataccgcctgaagggggaatcccggaaaacgttcgttgagctgatgcgcagaggggacctacccgtctggctagcgcataaggtggcgagcgagggcatcaagtacaccgaccgcaagtggtgctttgacggcgagcggaacaatcaaatcctggaggagaatatggatgtggagatctggacgaaggagggcgagcgcaagaagctacgcccgaggtggctggatgcacggacgtactctgaccccctagccctcaaggagttcaaagacttcgcggccgggagaaagagcatagccctcgacctcgtcacggagatcggccgcgtaccctcccacctcgctcatcggacccggaacgccctggacaatctagtgatgctccatacgagcgagcacggcgggcgggcgtaccgtcacgccgtcgaggagttaccggaaacaatggagaccctgctcctgttgggcctaatgatcctgctgaccgggggtgcaatgctattcctgatatctggcaaaggaataggcaaaacctcgatcggacttatctgcgtgattgtgagctccggcatgttatggatggccgatgttccactacagtggatcgcgtccgcaatcgttctggagttcttcatgatggtgctcctcattccggagcctgagaaacagcgaaccccgcaagacaaccagctggcctacgtcgtcatcggcatcctcacgctagccgcgatagtagcggcaaatgagatgggcctgctcgaaaccacgaagcgcgacctgggcatgtccaaggagcccggcgtcgtgagtcccacctcctacctagacgtggacttgcaccccgccagcgcttggacactgtacgcagttgcgacgacggtgatcacgccgatgctgcggcacacaatcgaaaactccaccgcgaacgtgagtctcgccgcgattgccaatcaggcggtcgtcctgatgggcttggacaaggggtggcccatctcaaagatggaccttggcgtgcctctgctggccctcgggtgctacagtcaggtcaatcccctgacactcaccgccgccgttctcctgttggttactcactatgccatcatcggcccggggctacaagccaaagccactcgcgaggctcaaaagcggacagccgctgggattatgaagaaccccactgtcgatggcatcatgaccatcgacctggaccccgttatctacgactccaagttcgagaaacagctggggcaggtaatgttactggttctgtgcgcggtacagttacttctcatgcgtacctcgtgggccctctgcgaggccctgacattagcaacgggaccgatcaccaccctctgggagggatccccggggaagttctggaacacgactatagccgtaagcatggctaatattttccgggggtcctacctggccggagccggacttgccttcagcattatgaagtccgtcgggaccggccgccggggcacggggagtcagggcgagaccctcggtgaaaagtggaaaaagaaattaaatcaattaagccgcaaggagttcgacttatacaagaaatccggcattactgaggtggaccggacagaagcgaaggaggggctgaaacgcggcgagaccacccatcacgccgtaagccggggctcggccaagctgcagtggttcgtcgagcgcaacatggtgatccccgaaggtcgcgtaatcgacctaggttgcggaagaggagggtggtcttactattgcgccggtctgaagaaggtaacggaggtgaggggctacacgaaagggggccccggccacgaggaacccgttcccatgtccacctatggctggaatatcgtgaagctaatgtctggcaaggacgttttctacctaccacccgaaaagtgcgataccctgctgtgcgacatcggcgagtccagcccctccccaacggtggaggagtcgcggaccatcagggtcctgaaaatggtggagccctggctcaagaacaaccagttctgtattaaagtgcttaacccctacatgcccaccgtaatcgagcacctggagcgactacagcgcaagtacggcgggatgctggtgcgcaacccactgtcccgcaattccacccacgagatgtactggatctccaacggcacagggaacattgtgtcctcggtgaacatggttagccgtctcctgctcaaccgctttaccatgactcaccggaggcctaccatagagaaggacgtcgacttaggcgccgggacgcggcacgtgaacgcggaacccgagacaccgaacatggacgtgatcggtgagcgaatcaagcggatcaaggaggagcactctagcacctggcactacgacgatgagaatccctacaaaacctgggcgtatcacggctcgtatgaggtaaaggccacagggagcgccagctccatgattaacggcgtggtaaaactgctcaccaagccatgggacgtagtgcccatggtgacccagatggccatgaccgacacgactcctttcggtcaacagcgcgtgttcaaagagaaggtggacacacggacccctcgtccaatgcccggcacgcggaaggtgatggagattaccgccgagtggctctggaggacacttggccgcaacaagaagccccgtctgtgtacccgggaggagttcactaagaaggtcaggaccaacgccgcgatgggggcagtgttcacggaggagaaccagtgggacagcgcgagagcggccgtggaggacgaggagttctggaaactcgttgaccgagagcgtgagttgcacaaactgggcaagtgcgggtcgtgcgtgtacaatatgatgggaaaacgggagaagaaacttggggagttcggcaaggccaagggaagccgcgccatatggtacatgtggctgggggcgcgttacctggagttcgaggccctcggcttcttaaacgaggaccactggttcagcagagagaacagctactctggagtggagggcgaggggctgcataagctgggctatatcctgcgggacatcagcaaaatcccgggcggggccatgtacgccgatgacaccgccgggtgggatacgcgaatcaccgaggatgacctccacaatgaggagaaaataacccagcagatggatcccgagcatcgacagctcgcgtccgcgatctttaaactgacctatcagaacaaggtcgtgaaggtccagcgtcccacgccgaaagggacggtaatggatatcatcagccggaaggaccagcgcggctccggtcaggtggggacctacggtttgaacacatttactaacatggaggcccagctcgtgcggcagatggagggggaaggggtcctgagcaaggcggacctggaaaacccacaccttctggagaaaaagataactcagtggttggagaccaaaggtgtggaacgcctgaagcggatggccatcagtggcgacgactgcgtggtcaagccgatcgacgacaggtttgcgaacgcgctgctggccctaaacgatatgggcaaggtgcggaaggacatcccgcagtggcagccaagcaaggggtggcatgactggcaacaggtgccattctgttcccaccactttcatgagcttattatgaaggacggtcgcaagctggttgtgccttgccgcccgcaggacgagctcatcgggcgggccagaatttcccagggcgccgggtggtccctgaaggagacagcctgcctgggcaaggcttacgctcagatgtggagcctcatgtactttcaccggcgcgatctgcgactggcctccaacgccatttgtagcgccgtgccggtccactgggtgcctacatctcgcaccacctggtccatccacgcgcaccatcagtggatgaccactgaagatatgttaacggtgtggaatcgggtatggattgaggacaacccctggatggaggataagacccccgtaaccacctgggaggacgtgccatacttgggtaagcgcgaggaccagtggtgcgggtcactgatcggcctgacgtctcgggcgacctgggcacagaacatcctgacggccatccagcaggtccgcagcctgatcggggatgaggagtttctcgactacatgccctccatgaaaagattcagaaaggaggaagagagtgagggtgccatctggtga

SEQ ID NO: 26205 - RNA, 9873 nt, synthetic construct
  misc_feature 1..9873: note = derived and/or modified CDS sequence (opt11) from DENV-3__DQ675522__SS-prME
  source 1..9873: mol_type = other RNA
accagcttctgtctcatgatgatgttgcccgccaccttggcgttccacctgacgtcccgtgacggcgaaccgcggatgatcgttgggaagaacgagcgcggcaagagcctgctgttcaagactgcctccgggatcaatatgtgcacactgattgccatggacttgggcgagatgtgcgacgacacggtcacgtacaagtgccccctcatcgccgaggttgagcccgaggacatagactgctggtgcaacttgacgagtacctgggtaacttacggaacgtgcaaccaggcaggcgagcatcggcgagacaaacggagtgtcgctctagcgccccacgtaggtatggggctcgacaccaggacccagacgtggatgagcgccgagggcgcctggcgtcaggtggaaaaagtcgagacttgggccctgcgccaccccgggtttaccatcctcgcgctgttcctggcccattacataggaacctccctgacccagaaggtggtaatcttcatcttattgatgttggttacacccagcatgaccatgcggtgcgtgggcgtcggcaaccgcgacttcgtcgaagggctgtccggggccacctgggtcgacgttgtcctggaacacggcgggtgcgtgaccacgatggccaaaaacaagcccactttagacatcgagctgcagaaaaccgaggccacacagctggcgacactccgtaaattgtgtatcgagggcaagatcaccaacatcaccaccgacagtcgctgccccacgcagggcgaagctatcctcccggaggagcaggatcagaactacgtgtgcaagcacacctacgtcgaccgggggtggggcaacgggtgcggcctcttcgggaagggctccctggtgacctgcgccaaattccagtgcctggagcccatcgaaggtaaggtagtccaatatgagaacctcaaatacaccgtgatcataacggtgcacaccggtgaccagcaccaggtcggcaacgatacccaaggggtcaccgtcgagattacaccccaagctagcaccgttgaggcggtactgcccgagtacggcacgctgggtctcgagtgctcccctcgcaccggtcttgatttcaacgaaatgatcctgctcaccatgaagaacaaggcgtggatggtgcaccggcagtggttcttcgacctgcccctgccctggacgagcggcgccaccaccgagacccccacatggaaccgcaaggaactcctggtgacattcaagaacgctcacgccaagaagcaggaggttgtggtgcttggatcccaggaaggtgccatgcacactgcgctcactggcgcgacggaaatccagaacagcggagggactagcattttcgccggccatctcaagtgccgactgaaaatggacaagctcgagctgaagggtatgagctacgccatgtgcctgaacaccttcgtgctcaagaaagaggtttccgagacccagcacgggacgatcttgatcaaggtcgaatataagggcgaggacgccccgtgcaagatccctttctcgacggaggacggtcagggcaaggcgcacaatggccgcctgattaccgccaatcccgtagtaacaaagaaggaggaacccgtgaatattgaggccgagccgcccttcggggagagcaatatcgtgatcggcattggggataaagccctgaagatcaactggtacaagaaaggaagcagcatcgggaaaatgttcgaggcgaccgcccggggagcccggcggatggcaatcctgggcgacaccgcctgggacttcggatccgtaggcggggtgctgaacagcctggggaagatggtacaccagatcttcggcagcgcgtacacagccctcttcagcggcgtttcctggatcatgaagattggcattggggtactgttaacttggatcggcctcaatagcaagaacacgtccatgagtttctcctgtatcgtgatcggcataattaccctgtacttgggcgcggtagtacaggccgacatggggtgtgtgatcaactggaagggaaaggagctcaagtgcggcagcggtatatttgtcaccaacgaggtgcacacctggacggagcagtacaaattccaagccgactcccccaagcgcttagcgaccgccatagctggcgcctgggaaaacggagtgtgcggtataagaagcaccacccggatggaaaacctgctctggaaacaaatcgcgaatgaattgaactacatcctctgggagaacaacatcaaactcacggtcgtggtaggggacatcatcggcgtcttggagcaaggcaagcgcaccctgaccccccagccgatggaactcaaatactcctggaagacctgggggaaggcgaagatcgtgacggccgaaatccagaacagctccttcataatcgacggaccaaacacccccgaatgcccgagtgcctcccgggcctggaacgtgtgggaggttgaggactacggtttcggcgtgttcaccaccaacatctggttaaagctgcgcgagatgtacacgcagagctgcgaccaccggctcatgtctgctgccatcaaggacgagcgagccgtccatgccgacatgggctactggatcgagtcccagaaaaacgggagctggaaactggaaaaggcctcattcatcgaggtcaagacctgtacgtggcccaagagccacaccctctggtccaatggcgtgctcgagagcgacatgatcatccccaagtccctggcggggcccattagccagcacaaccaccggccgggctatcacactcaaaccgccggcccgtggcacctgggtaagctcgaactggacttcaactattgcgagggtacaacagtggtcattactgagaattgcgggacacgcggaccctccctgagaaccaccaccgtgagcgggaagttgatacacgagtggtgctgtcgttcctgcacactgcccccgctgcggtatatgggggaggacggttgctggtacggcatggagatccgccccatcaacgagaaggaggagaacatggtgaagagcctcgtctccgctggctcaggaaaggtggataacttcactatgggcgtgctgtgtctggctatactctttgaggaggtcatgcgggggaagttcggcaaaaagcacatgatcgttggagtgctgttcactttcgtcctattgctttccggccagatcacctggcgcgacatggcccacaccttgataatgattggcagcaacgcgtccgatcgcatggggatgggcgtcacctatttagccctgattgccactttcaagatccagcctttcctagcactcgggttcttcctgcgcaagctcaccagccgggagaacctcctgcttggcgtgggcctcgccatggccacgaccctgcagctgcccgaggacatcgagcagatggccaatgggatcgccctcggcctgatgaccctgaagctcataactcagttcgaaacgtaccagctatggactgcgctggtcagcctcacctgctcgaacactatattcacgctgaccgtggcatggcgtaccgccactctgatcctcgccggcgtcagccttctgccactctgccaatcttcgtccatgcggaagacggattggctgcccatgaccgtagccgccatgggagtccctcccctgccgctcttcatcttcagcctcaaggatacacccaagcgccggtcttggccactgaacgaaggggtcatggccgtgggcttagtgagcatcttggccagtagcctgctccggaacgacgtccctatggctggcccgctggtcgccggcggcttgctcatcgcgtgctatgtaatcaccgggacgagcgcggacctgaccgtcgaaaaggccgccgacgtgacctgggaggaggaggctgagcagaccggagtgagccacaacctgatgatcacggtcgatgacgacgggaccatgcgcataaaggacgacgagactgagaacatcctcaccgtgctgctgaagaccgccctgctgatcgtgtccggcatattcccgtacagcatacccgcgacactgctcgtttggcacacttggcagaagcaaacccagcgtagtggtgtgctgtgggatgtgcccagccctcctgagacccagaaagctgagctggaggagggtgtgtaccgcatcaagcagcagggcatcttcggcaagacgcaggtgggcgtgggggtccaaaaggagggcgttttccacaccatgtggcacgtgaccaggggcgctgtcctgactcacaatgggaaaagactggagcccaactgggcctccgtgaaaaaagatctgatcagctacggcgggggctggcgcttgtccgcacaatggcagaagggcgaggaagtgcaagtcatagctgtcgagcccggcaagaacccgaagaactttcagacgatgcctggcatctttcagaccaccaccggggagatcggagccatcgccctggacttcaaacccgggacgagcggcagcccgataatcaaccgcgagggcaaggtggtcggactatacggcaacggtgtggtgaccaaaaacggcggttacgtctccggcatcgctcagaccaacgcagagccggacggccccacccccgaactggaggaggaaatgtttaagaagcggaacctcacgatcatggacttacacccggggagcggcaagaccaggaagtacctgcccgccatcgtgcgggaggcgattaagcggagactccgcaccctgatattggccccgactcgggtggtcgccgcggagatggaggaggccctcaaagggctgcctatacgctaccagactaccgccaccaagtccgagcacaccggcagagagatcgtcgacttgatgtgccacgccacgttcaccatgcgcctcctgagccctgtccgcgtccccaactacaacttgatcatcatggacgaggcccacttcaccgatcccgcgagcatcgccgctcgagggtatatatcaacccgggttggcatgggcgaggccgccgcaatattcatgacagccacgcctccgggtaccgctgaggcattccctcagagtaatgcacccattcaggacgaggagcgcgatatccctgagcgcagctggaattctggtaacgagtggattacagacttcgtggggaagacggtctggttcgtgccgtcaatcaaggccggcaacgacatcgctaattgcctccggaaaaatgggaagaaggtgatacagctgtctagaaagaccttcgacacagagtaccagaagactcggctgaacgactgggactttgtcgtgacgaccgacatctcagagatgggcgcgaatttcaaggccgaccgcgtcatcgaccctaggcgctgcctcaagcccgtcatcctaaccgacggtccggagcgagtgatcctggctgggcctatgcccgtgaccgccgcgtccgccgcacagcgtcgggggcgcgtcggtaggaatcctcagaaagagaacgaccagtacatcttcactggccagcccctcaacaacgacgaggaccacgcgcactggaccgaggcaaagatgctgctggataacataaataccccggagggcataatccccgcactcttcgagcccgaaagggagaagagcgcagccatcgacggcgagtaccggctgaaaggagagtcccgcaagacattcgtggagctgatgcggcgcggggacttacccgtctggctggcgcataaagtggccagtgagggcatcaagtacaccgaccggaagtggtgcttcgacggcgaacgcaacaatcagatcctggaagagaatatggacgtggagatatggacgaaagagggcgagcgcaagaagctccgcccacgctggctggacgcccggacgtattccgaccccttggcccttaaggagttcaaggacttcgcggcaggccgcaagagcatcgccctggatctggtcaccgagatcggtcgggtgcccagccacctcgcccaccgtacccggaatgccctggacaatctggtgatgctccacacgagcgagcatggcgggcgcgcgtatcggcacgcggtcgaggagctgcctgaaaccatggagacgctgctcctgctgggactcatgatcctgctcaccggtggcgccatgttgttcctgatcagtgggaaggggatcggcaaaacgtctatagggctgatctgcgtgatcgtgagctccggcatgctctggatggccgacgttcccctgcagtggatcgccagcgcgatcgtattggagttcttcatgatggtgctcctgatccccgagcccgagaaacagcgaaccccacaggacaaccagttggcctacgtcgtaattgggatactcaccttggccgccatcgtggcggcgaacgaaatgggcctgcttgagaccacgaaacgggacctagggatgtccaaagagcccggggtggtgtcaccaacctcctacctggacgtggacctgcaccccgccagtgcctggactctatatgccgtcgccaccacggttattaccccgatgctgcgccacaccattgaaaacagcacagctaacgtgagcctcgccgcgatcgccaaccaagccgtcgtgttaatgggcctggacaaggggtggccgatctccaaaatggacctcggcgtgcctttactagcccttgggtgctacagccaggtcaaccccctgacactcaccgccgccgtgctcctcctagtcacacactacgccatcataggcccgggcctccaggcgaaggccacccgggaggcccagaaaagaaccgccgccggtatcatgaagaacccgacagttgacggcatcatgaccatcgacctggacccggtgatttacgatagcaagttcgagaagcagctggggcaggttatgttactggtcttgtgtgcggtgcagctcctgctgatgcggaccagctgggccctctgcgaggccctgacgctggccaccggcccaatcaccaccctttgggagggttccccggggaaattctggaacacaaccatcgcagtgtctatggcgaacatcttccgcggttcctacctcgccggagccggactggccttcagcatcatgaaatccgtcgggaccggccggcgcggcaccgggtcccagggcgaaacgctcggggagaaatggaagaagaagctcaaccagctcagccggaaagagtttgacctttacaagaagtccggcatcaccgaggtggatcgcaccgaagcgaaagagggactgaagcggggcgagaccacgcaccacgccgtgagccgcggctccgccaagttgcagtggttcgtagagcgtaacatggttatccccgaagggagagtgatagacctcggctgcgggcgcggcggatggagctattactgcgcaggcttgaagaaggttacggaggtgagaggctacaccaagggtggccctggtcacgaggaaccggtgccgatgtccacatacggctggaacatcgtcaagctgatgagcgggaaggatgtgttctacctcccccccgagaagtgcgacactctgctgtgcgacatcggcgaatccagcccatccccgacggtagaggagagccgcactatccgggtgctgaaaatggtcgagccctggctcaagaacaaccagttctgcatcaaggtgctgaacccctacatgcctaccgtcatcgaacacctggagcgcctccagcggaagtacggtgggatgctggtgcgcaacccgctgtcccggaactcgacccacgagatgtactggatctctaacggtacggggaacatcgtgtcgtccgtaaatatggtgagccgcctcctgttaaacaggttcaccatgacccaccgccggcccaccatcgagaaggacgtcgacctcggcgccggcacgcgccacgtaaacgcagagcccgagaccccgaacatggacgtgatcggtgagcggattaagcggatcaaggaggagcactccagcacctggcactacgacgacgagaacccctataagacctgggcctatcatgggtcctatgaagttaaggcgacggggagcgcttcttccatgattaacggagtggtgaagctactgaccaagccgtgggacgtcgtgcccatggtgacccagatggccatgactgacacaacgccgttcggccagcagcgggtcttcaaagagaaggtcgacacccgcaccccacgacccatgcccggaacgcgcaaggtaatggagattaccgcggagtggctctggcggaccttaggccgcaacaagaagccacgcttatgcacccgcgaggagttcacgaagaaggtgcgcacgaacgccgccatgggggcagtattcaccgaagagaaccagtgggacagcgcccgtgcggcggtggaggacgaagagttttggaaactcgtcgaccgcgagcgggagctgcacaaacttggcaagtgcggttcctgcgtgtacaacatgatgggcaaacgtgagaagaagctcggagagttcggcaaggccaagggcagccgggccatatggtacatgtggctgggcgcgcgctacctggagttcgaggccttaggattcctcaacgaggaccactggttctcccgggagaacagctactccggagtggagggtgaagggctgcacaagttaggttacatacttcgcgacatcagcaagatccccgggggggcgatgtacgccgacgacaccgccggctgggacacccggataaccgaagacgacctacacaacgaggagaaaatcacccagcagatggatcccgagcaccgccagctcgcctcagccatctttaaactgacctaccaaaataaggtagtgaaggtccagcggcccactccgaaggggaccgtcatggacatcatcagccgcaaggaccagcggggctccggccaggtgggtacctacggcctgaacacttttacgaacatggaggcccagctcgtacgccaaatggagggcgagggcgtcctgagcaaggccgacttagaaaacccccatctcctggagaagaagatcacgcaatggctggaaaccaagggggtggagcggcttaagaggatggccatctccggcgacgactgcgttgtcaagccgatcgacgaccggttcgcaaacgctctgctggctctcaacgacatgggcaaggtccgcaaggacattccccagtggcagcctagcaaggggtggcacgattggcagcaggtacccttctgctcccaccacttccacgaattaattatgaaagacggccgcaagttggtcgtgccctgtcgaccccaggacgagctcattgggcgcgcccgtatctcacagggcgccgggtggtcattaaaggagacagcgtgtctgggtaaagcctacgcccagatgtggagcctcatgtactttcacaggcgggacctacgcctggcctcaaacgccatctgctcggcggttccagtacactgggtgcctaccagccggacgacctggtccattcacgctcaccaccaatggatgaccaccgaggacatgctcactgtgtggaatcgcgtctggatcgaggacaacccgtggatggaggataagacaccggtgaccacatgggaggacgtcccgtacctgggaaagagggaggaccagtggtgcggcagcctgattggcctcacctcccgcgccacctgggcccaaaacatcctgaccgcgatccaacaggtccggagcctgatcggggacgaggagttcctcgattacatgccctccatgaagcgcttccgtaaggaggaggagagcgagggcgccatctggtga

SEQ ID NO: 26206 - RNA, 9873 nt, synthetic construct
  misc_feature 1..9873: note = derived and/or modified CDS sequence (opt11) from DENV-3__DQ675527__SS-prME
  source 1..9873: mol_type = other RNA
accagtttttgcctgatgatgatgctccccgcaacactggcctttcatctcacctcacgtgacggagaaccccgaatgatagtcgggaaaaacgaacgcggaaaaagtctcctattcaaaacggcatccggaatcaacatgtgtaccctcatagccatggatctcggagaaatgtgcgacgataccgtgacctacaaatgccccctcatagcagaagttgaaccggaagacatcgactgctggtgcaacttgacgagcacatgggtgacatatggtacctgtaaccaagcaggagagcatcgaagagataaacgtagcgtcgcattggcaccccacgtggggatggggcttgatacaagaacacaaacctggatgtcggcagagggggcttggcgacaagtggaaaaagtagaaacctgggcgctccggcatccaggcttcactatcctggctttgttcctagcccactacattggaacttcattaacacagaaagttgttatttttatactacttatgctcgtcacaccaagcatgactatgcggtgcgtaggggtcgggaaccgggatttcgtagaaggtctaagcggcgcaacatgggtagacgtggttctggaacacggaggttgcgttaccacaatggcgaaaaacaaacccaccttagacattgaactgcaaaagaccgaggcaacacagttagcaacgctaagaaaactctgcatagagggcaaaataacaaacattacgacagactccaggtgcccaacccagggggaggcgatactcccggaagaacaggatcaaaactatgtttgcaaacacacctacgtagatcgagggtgggggaatggatgcggattgttcggaaagggaagcctagtcacatgcgccaagttccaatgcctcgagcccatagaaggaaaggtcgtccagtacgagaacctcaagtacactgtgataatcactgttcacaccggtgaccaacaccaggtgggaaacgatacacaaggtgtgacggtggagatcacgccgcaagcaagtacggttgaagcagtcctacccgaatatggaacgttaggcctcgaatgcagtccgcgcaccggtctcgacttcaacgaaatgatattgctcacgatgaagaataaggcatggatggtgcaccgacagtggttcttcgacctgcccttgccgtggaccagcggagccaccaccgagacacccacctggaacagaaaagagctgctggtcacgtttaagaacgcccacgcaaagaaacaggaagtcgttgtcctaggctcgcaggagggagcgatgcacacggcgctcacaggcgccaccgaaattcaaaactcagggggaaccagcatcttcgcaggccacctaaaatgccgattgaaaatggacaagctagagcttaagggcatgtcctacgcaatgtgtctaaatacgttcgtactcaagaaagaagtaagtgaaacgcaacatggtaccatcctgataaaggtagaatacaaaggagaagacgcaccatgcaaaatacccttcagcacggaggacggccaaggaaaagcacacaatggacgactaatcacagccaacccggtcgtcactaagaaagaagaaccagtgaacatcgaggcagaaccacctttcggtgagagcaacattgtgataggaataggagacaaagcgctgaagatcaactggtataagaaagggagttccataggcaagatgttcgaagctacagcacgtggagcgcgacgaatggcaatccttggggatactgcctgggattttggctccgttggaggtgtgttgaactccctagggaaaatggtccatcagatattcggttcagcttacacggcactcttttcaggcgtttcctggattatgaagataggaatcggggttctgctaacctggatcggccttaacagtaagaacacctccatgtctttctcatgcatagtaatcggcatcataacactatatcttggagcagtcgtccaagccgacatggggtgcgtaataaactggaaaggtaaggaactcaaatgcggatcggggatattcgtgactaatgaggtacacacttggactgaacaatacaagttccaagccgacagccccaaacggctagcgaccgcgatagctggtgcgtgggagaacggagtttgcgggatacgtagcacaaccagaatggaaaacttgctctggaaacagattgccaacgaactcaattatatattgtgggaaaataacataaaacttacggttgtcgtcggggacataataggcgtactcgagcaaggaaaaagaacccttactccccaaccaatggaactcaaatatagctggaaaacctggggcaaggcaaaaatagtaaccgccgaaatacaaaacagtagcttcataatagacgggccgaatacacccgagtgcccatcagcaagccgagcatggaacgtgtgggaagtagaggactacggcttcggagtgttcaccacgaatatctggctgaaactgcgtgaaatgtacacgcaatcctgcgaccatcggctaatgtctgcagccatcaaggatgaacgcgcagtacacgcagacatgggatactggatagagagccagaaaaacggctcttggaagttagaaaaggcatcattcatagaagtaaagacgtgtacctggccaaagagtcatacgctctggagcaacggggttcttgaatcagacatgatcatcccaaaatccctcgccggccccatcagccaacacaatcatcggcctggctaccacacccaaacagccggaccatggcacctcgggaaattagaactagacttcaactactgtgaaggaacgaccgtagtaatcacagagaactgcggcacacgaggcccaagtctgcggacaactaccgtttcagggaagctcatccacgaatggtgctgcagatcctgcaccctacccccactaagatacatgggagaagacgggtgctggtacggaatggaaatccgtcccataaacgaaaaagaagaaaacatggtcaaatcgctagtttccgcggggtcgggcaaagtagacaactttacgatgggcgtactctgcctcgcgatccttttcgaagaagtaatgagaggcaaattcggcaaaaagcacatgatcgtaggcgtgctattcaccttcgtcctgctcctaagcggccaaattacgtggcgcgacatggcccacacgctcatcatgataggatcaaacgcgtcggatagaatgggaatgggtgtaacgtaccttgcattgatagccaccttcaaaatccaaccctttctcgctctggggttcttcctacgaaaactaacgtcccgagaaaacctgctcttaggggtgggcctcgccatggcgacaactctccaactacccgaggatatagaacaaatggcaaacggcatagcgctcggccttatgaccctaaagttaatcacacaatttgaaacgtaccagctatggacagcgctggtcagcctaacctgctcaaacacgatattcaccctaacggtggcctggcggacggcaacacttatactcgcaggagtctcactgctgcccctatgccaatccagcagcatgagaaaaactgactggttgcccatgaccgttgccgcaatgggagtaccaccactccctctgttcatcttcagcctcaaggacacgccgaaacggcgaagctggccattgaacgaaggagtcatggccgtcggattagtgagcatcttagcatcctcgctgttgcgaaatgacgtacccatggccggacctctagtcgccggcggtctgctgatagcgtgttacgttatcacaggaaccagcgcagacctgaccgttgagaaagccgcagacgttacgtgggaggaggaggcagagcaaaccggagtaagtcacaacctaatgattaccgtcgacgacgatggaacgatgcggataaaagacgacgagactgagaacattttgacggtacttcttaaaacggcgctgctaatagtcagtggcatcttcccatactcaatcccagccaccctactggtttggcatacttggcagaagcagacgcaacgaagcggagtgctctgggacgtaccctccccacccgaaactcaaaaagcggaattggaagagggagtctatcgaataaaacagcaagggattttcggcaaaacccaagtaggggtaggagtacaaaaagagggtgtatttcacacgatgtggcatgtgacgcgcggagcagtactcacacataacggcaaaagactcgaacccaattgggcgagtgttaaaaaggacctaatatcatacggcgggggatggcgcttgtcagcgcagtggcaaaaaggagaagaagtacaggtcatcgccgtggaaccggggaaaaatcccaaaaattttcaaacaatgccggggatttttcaaacgaccactggagaaatcggagcgatcgcgcttgacttcaagcccggtacaagcggctcgcccataattaatcgtgaagggaaggtagtaggcctatacggaaatggagtagtaacgaaaaacgggggatatgtaagcggcattgcacaaacgaacgctgaaccggatggaccaacacctgaactggaagaggagatgttcaaaaagcgaaaccttaccattatggatctgcaccccggctcggggaaaacgcgaaaatacctgcccgctatagtaagggaggcaattaagcgccggcttaggacactaatactagcgcccacccgcgttgtagccgccgaaatggaagaagcactgaaggggctccctatccggtaccaaaccacggctaccaaaagcgagcacacggggagagaaatagtcgaccttatgtgccacgccacgtttaccatgcgtctcttgagccccgtacgcgtacccaattataacttaatcataatggacgaagcccacttcacagacccggcctccatagcagctagaggatacatcagtacgagagtggggatgggtgaggccgcagcgatcttcatgacagccacgccgcccggaacagcggaagcgttcccacaatcaaatgcaccaattcaggacgaagagagagacatcccagagcgaagctggaactccgggaacgagtggatcaccgactttgtaggaaagacagtttggtttgttccatcaattaaagcagggaacgacatagccaactgcctccggaaaaacggcaagaaagtaatccaactgagccgaaagacattcgacaccgaataccaaaagacccgtttaaacgattgggatttcgtagttaccactgatattagcgagatgggagccaattttaaagcagaccgggtgatagacccacgtaggtgcctgaagccggttatactaaccgacgggcccgaacgagttatattagcggggccaatgcccgtgaccgccgcctccgccgcccaaagacgaggacgggtcgggcgaaacccgcaaaaagaaaacgaccagtatatattcactggccaacccctcaacaacgacgaagaccacgctcattggacagaagcgaaaatgctcctggacaatataaacacgccagaggggataataccagcactctttgaacccgagcgcgagaaaagtgctgcaatcgacggcgaatacagattgaagggtgaatcgcgcaaaacattcgtggaactcatgaggcggggagacttaccggtctggctagcacacaaagtggcgtcagaaggaataaaatacacagatcgcaaatggtgtttcgacggcgaacgtataaaccagatcctcgaggaaaacatggacgtcgaaatctggacgaaggagggggaaaggaaaaacttacgaccacgatggctggacgccagaacttattcagacccccttgcccttaaagagttcaaggatttcgctgccggacggaaaagtatcgcactcgacctggtgaccgaaatagggagggttccgtcgcacctggcccacagaacaagaaacgcgctggacaatttagtcatgctgcacaccagcgaacatgggggccgggcatatcgtcacgccgtcgaggaactacccgaaacgatggagactttactgctgttggggcttatgatccttctgacaggcggggccatgctattccttataagtgggaaaggtatcggaaagaccagcatagggctcatttgcgtaatagtaagcagcggcatgctgtggatggccgatgtccccctacagtggattgcgtccgcaatcgtcctcgaatttttcatgatggtattattaatcccagaaccggaaaaacagcggacaccgcaagacaaccaactggcgtacgtcgtaattggcattctgaccctggcagccattgtggccgccaacgaaatggggttacttgagaccacaaagagagacctaggcatgagcaaggaaccaggcgtcgtaagccccaccagctacttagacgtggacctacatcccgcgagcgcatggaccctatacgcagtagcgacgacagtgataaccccaatgctaaggcatacgattgaaaactccacagctaatgtcagtttagcggccatcgcaaaccaagcagttgttctgatgggtttagataagggctggcccataagcaaaatggacttgggcgtacccttgcttgccctcggatgctacagccaggtgaacccactcaccctgacagctgcagtactcttactggtgactcattacgcaatcatagggccggggttacaggcgaaggcgactcgcgaagcgcaaaagcgcacagcggcaggaataatgaaaaacccgaccgtagatggtatcatgaccatagacttggacccagtcatatacgactcaaagttcgagaaacagctcgggcaagtaatgttactcgtactgtgcgcagtccagctactgctgatgaggacaagctgggcgctgtgcgaggctttaacactcgcgaccggacccatcactaccctatgggaaggatcacctggtaagttctggaataccacaatagccgtaagcatggcaaacatattcagaggctcgtaccttgccggagccggactggcattttcaataatgaaaagcgtcggaaccggccggagagggaccggcagccagggtgaaacgctcggagagaaatggaagaagaaacttaaccaactctccagaaaggagttcgatttgtacaaaaagtcgggaataaccgaggttgaccgcactgaggcaaaagagggattgaaaaggggcgaaacgacccaccacgccgtctctcgtggatccgccaaactccagtggtttgttgaacgcaacatggtaatccccgagggaagagtcatagacctcggatgcggaaggggaggctggtcctactactgtgcaggcctcaagaaagtaacggaagtacgtggatacaccaaaggcggtccgggccacgaagaacctgtacccatgtccacatacgggtggaacatcgtcaaactgatgagcggcaaagacgtcttctacctcccacctgaaaagtgcgacactctcctgtgcgacattggagaatcaagcccctctccaacagtcgaagaaagccgcaccattcgtgtcctcaagatggtagagccgtggctcaaaaacaatcagttctgtatcaaggtcctaaacccctacatgccgactgtaatcgaacaccttgaacgcctacaacgcaaatatggaggtatgttggtccgaaaccccctgtccagaaacagtactcacgaaatgtactggataagcaacggtactgggaacattgtatcaagcgtgaacatggtctcccgcctcttgcttaacagattcacgatgacacatagacgaccaaccatagaaaaagacgtagatctaggcgctgggaccaggcacgtcaatgccgaacccgaaaccccgaacatggacgtaatcggcgaacggatcaagcgaataaaagaggaacactcatcaacgtggcattacgatgacgagaacccctacaagacctgggcctaccatggcagttatgaagtgaaagcaaccggctccgcaagcagtatgataaacggggtcgtcaagctgttgaccaaaccttgggatgtagtccccatggtaacacaaatggccatgaccgacacaacacccttcggtcagcaaagagtattcaaagagaaagtcgacacaaggactccaaggccaatgccaggcacgcgtaaagtaatggaaataacggcagagtggctgtggagaacactcggcagaaacaagaaaccacgactctgcacgcgggaagagtttaccaagaaagtccgcacgaatgcagccatgggcgccgtcttcactgaagaaaatcaatgggactcagcaagggcagcggtcgaggatgaggagttctggaagctagtagaccgcgagcgggagttacataaactcggcaaatgcggatcatgcgtctacaacatgatggggaaacgagagaagaaacttggtgagttcgggaaagcaaagggctcgagggcaatatggtacatgtggctgggagcacgatacctagaatttgaggctttgggttttctgaacgaagaccattggttcagcagagaaaactcctactcgggagtggagggcgagggcctacacaagctagggtatatcttacgagacatatcaaagatacctggtggggcaatgtacgcggacgatacagccgggtgggatacgagaatcacggaggacgacctacacaacgaagaaaagataacccagcaaatggaccctgagcacagacaactagccagcgcaatcttcaaacttacgtaccaaaataaagtcgtcaaggtgcaacgcccgacacccaaaggaacagttatggacataatatccaggaaagaccagcgaggaagcggtcaagttggaacgtacggactgaacacgttcaccaacatggaagcccaactcgtacgccaaatggagggggaaggagtgctaagcaaggccgacctcgagaacccacacttactcgaaaagaagattacccaatggctggagactaagggggtggagagacttaaaaggatggcgatcagcggagatgactgcgtggtaaagcccatcgacgacagattcgccaacgccctgctagctctgaacgacatgggaaaagtgcgcaaagatataccacaatggcagccaagcaaaggatggcacgactggcaacaagtacccttttgcagccaccatttccacgaactaataatgaaggacggacgtaagctagtagttccttgtcggccccaagacgaactaataggcagagcacggatctcgcaaggggccgggtggtcgctaaaagaaacagcatgcctaggcaaggcttacgctcagatgtggtccctaatgtacttccatcgtcgagacctccgactggcgtctaacgccatctgctccgcggtaccagtacactgggtgccgacctcgaggaccacatggtctattcacgctcaccaccaatggatgactaccgaagacatgttgaccgtctggaatagggtctggattgaggacaacccctggatggaagataagaccccagtgactacgtgggaggacgtcccgtatctaggaaagcgggaagatcaatggtgcggctcactcataggtctgacgtcgcgagcaacatgggcccagaacatccttactgcaatccagcaggtccgatcgctgatcggagacgaagagttcctcgactacatgccatcaatgaagcgcttccgaaaagaagaggaaagcgaaggggcgatctggtaa

SEQ ID NO: 26207 - RNA, 9873 nt, synthetic construct
  misc_feature 1..9873: note = derived and/or modified CDS sequence (opt11) from DENV-3__DQ675528__SS-prME
  source 1..9873: mol_type = other RNA
accagcttctgcctaatgatgatgctccccgccactttagcctttcacctcacgtcccgcgacggcgagccgcggatgatcgtggggaagaacgagcgcggcaagagcctcctgttcaagaccgcgtccggtatcaacatgtgtaccctgatcgccatggacctcggcgagatgtgcgacgacacggtcacgtacaagtgccccttgatagccgaggtggagcccgaggacatcgactgctggtgcaacctgacaagcacctgggtcacctacgggacgtgcaaccaggccggcgagcacaggagagacaagcgctccgtcgccctcgcgccgcacgtgggcatggggctggacacccgcacccagacctggatgagcgccgagggggcctggcggcaggttgagaaggtcgagacgtgggccttgcgccacccggggttcacaatcctcgcactgttcttggcccactacatcggcacttccctcacccagaaagtggtgatcttcattctgctgatgctcgtcacgcccagcatgaccatgagatgcgtgggtgtgggcaaccgcgactttgtcgagggcctgtccggggccacttgggtagacgtggtcctggagcacggcgggtgcgtgactaccatggccaagaataagcccaccctcgacatcgagttgcagaagaccgaggcaacccagctggcgacgctccggaagctgtgcatcgagggcaagataaccaatatcactaccgacagccggtgtcccacacagggagaggcgatcctaccagaagagcaggaccagaactacgtgtgcaaacacacgtacgttgaccgggggtggggcaacgggtgtgggctcttcgggaagggctccctggtgacctgcgccaagttccagtgcctggagcccatcgaaggcaaggtggtccagtacgagaacctcaagtataccgtaataatcacggtgcataccggtgaccagcatcaggtcggcaacgacacgcagggggtgaccgtcgagataacgccccaggccagcaccgtggaggccgtcctgcccgagtatggcaccctggggctcgagtgctctccgcgcacaggcctggacttcaacgagatgatactgctcaccatgaaaaacaaggcgtggatggtccaccggcagtggttcttcgacctgcccctgccctggacgtccggcgccaccaccgagacccccacgtggaaccgcaaggagctcctggtgaccttcaagaacgcccacgccaaaaagcaggaggttgtcgtgctgggctcccaggagggcgccatgcatacggtgctcaccggggcgacggagatccagaatagcggcgggacatcgatcttcgcaggccacctaaagtgccggctgaagatggacaaattggaactcaagggtatgtcatatgccatgtgcctgaacaccttcgtcctaaagaaggaagtttccgagacccagcatgggacgatacttatcaaggtggagtacaagggcgaggacgccccgtgcaagatcccctttagcaccgaggatgggcagggcaaggcccacaatggccgcttgatcaccgcgaaccccgtcgtgaccaagaaggaggagcccgtaaacatcgaggccgagccaccattcggggagagcaacatcgtcatcggcatcggggacaaggccctgaagatcaactggtacaagaagggcagtagcatcgggaagatgtttgaggccacggcgcggggcgcccgccgtatggcaattctcggcgacaccgcctgggacttcgggagtgtgggcggcgtgctgaacagcctcggcaagatggtccatcagatcttcgggtccgcctacacggcgttgttctcgggcgtgtcctggatcatgaaaatcggaatcggggtgctgctgacctggatcggcctcaatagcaagaacacgtccatgagcttctcctgcatcgtcatcgggatcatcaccctgtacctgggcgccgtggtgcaggccgacatgggctgcgtaatcaactggaagggaaaggagctcaagtgcggcagcggcatcttcgtgaccaacgaggtacacacgtggactgagcagtacaaattccaggcagactcccccaagcgcctggcaaccgcgatcgccggcgcctgggagaacggggtctgcggcatacgctcaaccacccggatggagaaccttctgtggaagcagatagccaacgagctaaactatatcctgtgggagaacaacatcaagctcacagtggtggtgggcgacataatcggcgtgcttgagcagggcaagcgcaccctgaccccccagccgatggagttaaagtactcctggaagacctgggggaaggccaagatcgtgacggccgagatccagaacagctcgttcatcatcgacggccccaacacccccgagtgccccagcgcctcccgggcctggaacgtatgggaggtggaggactacgggtttggcgtgttcacaaccaacatctggctgaagctacgagagatgtacacgcagagctgcgaccaccggctcatgagcgccgcgataaaagacgagcgcgccgtccacgccgacatgggctactggatcgaatcccagaagaacggcagctggaagctggagaaggcttccttcatcgaggtgaagacctgcacctggccgaagagccacaccctgtggtccaacggcgttctcgagagcgacatgatcatccccaagtccctggcggggcccattagccagcacaaccaccgaccgggctatcacacgcagaccgccgggccctggcacctgggcaagctagagctggatttcaactactgcgagggtaccaccgtcgtgataaccgaaaactgtgggacccgcggcccctccctgaggacgacgaccgtgtcggggaagctcatccacgagtggtgctgccgctcctgcacgttgcccccactgcggtacatgggagaggacggctgctggtacggcatggagatccgcccaatcaacgagaaggaggagaacatggtcaagagcctcgtgtccgccggaagcgggaaggtggacaacttcaccatgggcgtcctgtgcctggccatcctcttcgaggaggtgatgagagggaagttcggcaagaagcacatgatcgtgggggtcctgttcacgttcgtgctgctcctgtctggccagattacctggcgcgacatggcccacacgctgatcatgataggcagtaacgcctccgatcggatggggatgggtgtgacctacctcgcgctgatcgcgactttcaagatccagcccttcctggccctcgggttcttccttcgcaagctgaccagccgggagaacctcctcctgggcgtcggcctcgccatggccaccaccctgcagctacctgaggacattgagcagatggcgaacgggattgccctcggcttgatgaccctcaagctcatcacccagttcgaaacgtaccagctgtggaccgccctggtgtctctaacgtgctccaacaccatcttcacgctgaccgttgcgtggcgcacagcgaccctgatcctcgccggcgtgagcctcctgccgttatgccaatcctcatccatgcggaagacggactggttgcccatgaccgtggccgccatgggcgtccccccgctgccgctcttcatcttcagcctgaaggacaccccaaagcgccgctcctggccactgaacgagggtgtgatggccgtgggcctcgtcagcatcctggcgtcctctctgctccggaacgacgtgcccatggctggcccgctggtggccggcggcctgttgattgcctgctacgtcatcaccggaacgtccgccgatctgaccgtggagaaggcggccgacgtgacctgggaggaggaggctgagcagaccggggtcagccacaacctgatgatcaccgtcgatgacgatggcaccatgcgcataaaggatgacgaaaccgagaacatcctcaccgtgctgctgaagaccgccctcctgatcgtctccggcatcttcccctacagcatcccggccacgctgctcgtgtggcatacctggcaaaagcaaacccagcggtccggcgtgctgtgggatgtccccagcccgcccgaaacccagaaagcggagctggaggagggggtgtaccgaataaaacagcagggcatcttcgggaagacgcaggtgggcgtcggtgtgcagaaggagggcgtctttcacaccatgtggcacgtcacccggggcgccgtgctcacccacaacgggaagcgcctggaacccaactgggcctccgtaaagaaggacctgattagctacggcgggggatggcggctttccgcccagtggcagaagggggaggaggtccaggtgatcgcggtggagcccggcaagaacccgaagaacttccaaacgatgcccggcatcttccaaaccaccaccggggagatcggcgcgatcgccctggacttcaagcccggaacgagcggcagcccaatcatcaaccgcgaggggaaggtcgtggggctgtatggcaacggggtggtcaccaaaaacggcgggtacgtgagcggcatcgcccagaccaatgccgagcccgacggccccacccccgaactggaggaggagatgtttaagaagcggaacctcacgatcatggacctgcacccggggagcggtaagaccagaaagtacctgcctgcgatcgtgcgggaagctatcaagcgccggctccgcaccctgatcctggcccccacccgggtcgtggccgccgagatggaggaggcgctcaaggggctgcccatccgctaccagacgaccgccaccaagtccgagcacacaggccgggagatcgtggacctgatgtgccacgccacgttcaccatgagactcctgagcccggtccgggtgcccaactacaacctcatcatcatggacgaggctcatttcacggaccctgcctccatcgcggctcgcgggtacattagcacacgggtggggatgggcgaggccgccgctattttcatgaccgcaactccgccggggaccgccgaggccttcccccagtccaacgcccccatccaggacgaggaacgcgacatcccggagcgcagctggaactccggcaacgagtggatcaccgacttcgtcgggaagaccgtttggttcgtgccgagcatcaaggcgggcaacgacatcgccaactgcctccggaaaaacgggaagaaggtcatccagctgtccagaaagaccttcgacacagaataccagaagacccggctgaacgactgggacttcgtggtgacgaccgacatcagcgagatgggggctaacttcaaggcagacagggtcatcgacccacggcgctgcctcaagcccgtgatcctgaccgacggccccgagcgagtgattctggcagggccgatgcccgtcaccgctgcctccgccgcccagcgccggggccgagtcgggcggaatccccagaaggagaacgaccaatacatcttcacgggccagcccctcaacaacgacgaggaccacgcccactggaccgaggcgaaaatgctgctggacaacatcaacaccccggaagggataatccccgccctcttcgagcccgaacgcgagaagtcggccgcaatcgacggcgagtacagactgaaaggtgagtcccgcaaaaccttcgtcgagctgatgcggcgcggagatctccctgtttggctggcccacaaggtggccagcgagggcataaagtacaccgataggaagtggtgcttcgacggggagcgaaacaaccagatcttagaggagaacatggatgtcgagatctggaccaaggagggcgagcggaagaagcttcgcccgcgctggttagacgcccggacctactcggaccctctggccctcaaggagttcaaggatttcgccgcgggccgcaagtcaatcgcactggacctggtgaccgagatcggccgggtgcccagtcacctcgcacaccgcacgcggaacgccctggacaatctggttatgctccacacgagcgagcacggtgggcgcgcctatcggcacgcggtagaggagctgccggagaccatggagaccctactcctgctgggccttatgatcctgctgaccgggggcgccatgctcttcttgataagcggaaagggcatcggcaagactagtatagggcttatctgcgtgatagtcagctcgggcatgttgtggatggccgatgtgcccctgcaatggattgcctctgccatcgttctggagttcttcatgatggtcctcctgatccccgaacccgaaaagcagcgcaccccgcaggacaaccagctggcgtacgtggtgatcgggatcctcaccctggccgccatcgtcgccgccaacgagatgggcctcctcgagaccacgaagcgggaccttggcatgtccaaggagcccggggtggtctcccctacctcctacctggacgtcgaccttcaccccgcgagcgcctggaccctgtacgccgtggctaccacggtgatcaccccgatgctgcgccatacaatcgagaactccaccgccaatgtcagcctcgcggccattgccaaccaagccgtggtcctgatgggcctggacaaggggtggcccatctccaagatggacctcggcgtccccctgctggcgctcggatgctatagccaggtgaaccccctgacgctgactgccgccgtgctcctgctggtaacccactacgctatcatcgggccgggcctccaggcgaaggcgacccgggaggcccagaagcgcacggccgccgggatcatgaagaaccccaccgttgacggcatcatgaccatcgatctggaccccgtgatctacgactctaaattcgagaagcaattgggtcaggtcatgctcctggtgctgtgtgccgtgcaactcctgctgatgcggaccagctgggcgctctgcgaggccctgacgctggccaccggccccattaccaccctttgggaggggtccccgggaaaattttggaacacgaccatcgccgtcagcatggccaacatcttccgcggctcctacctggcgggggccggactggctttcagtataatgaaaagtgtagggaccggccggaggggcaccgggagccaaggcgagacgctaggggagaagtggaagaagaagctaaatcagctgagccggaaggagttcgacctctacaagaaaagcgggatcactgaggtggaccgcaccgaggccaaggaagggctgaagcggggcgagaccacacaccacgcggtcagccgcggctccgccaagctgcagtggttcgtggagcggaatatggttatcccggaagggagggtcatcgatctcggctgcggtcgcggcgggtggagctactactgcgccggcctgaagaaagtgacggaggtgagaggctacaccaaggggggccccggccacgaggagcccgtcccgatgtccacctacggctggaacattgtgaagctgatgagcggaaaggacgtgttttacctcccgcccgagaagtgcgacaccctgctctgcgacataggcgagtcctccccctccccgacggtcgaggagtcccgcacaatccgggttctgaagatggtggagccctggctcaagaacaatcagttttgcatcaaagtcctgaacccctacatgcccaccgtgatcgagcacctggagcgcctccagcggaagtatggtgggatgctggtgcgcaacccgctgtcccggaactccacccacgaaatgtactggatctcgaacggcacggggaacatcgtcagctccgtgaacatggtcagccgcctcttactgaaccggttcaccatgacccaccgccgccccaccatcgagaaggacgtggacctcggcgccggcacgcgccacgtgaatgccgagcccgagaccccgaacatggacgtcattggggagcggatcaagcgcatcaaggaggagcactccagcacgtggcactacgacgacgaaaacccctacaagacctgggcgtaccacggctcctacgaggtgaaggccacggggagcgccagcagtatgatcaacggcgtggttaagcttctgaccaagccttgggacgtggtgcccatggtcactcagatggccatgaccgacacgaccccgttcggccaacagcgggtgtttaaagagaaggtcgatacccgcactccccggcccatgcccggcacgcgcaaagtcatggagatcacagccgagtggctctggcggaccctgggccgcaacaagaagccgcgcctgtgcacccgggaggagttcacgaagaaggtgcgcaccaacgcggccatgggagccgtgttcaccgaggagaaccagtgggacagcgcccgggcggccgtcgaagacgaggaattctggaagctcgtcgaccgcgagcgggaactgcacaagctgggcaagtgcggatcctgcgtgtataacatgatgggcaagcgcgagaaaaagctcggggagttcggcaaggccaagggctcccgggccatctggtacatgtggctgggggcccgctacctggagtttgaggccttgggcttcctgaacgaggaccactggttctcccgggaaaatagctactccggggttgagggcgaggggctgcacaagctcggctacattttacgcgacatcagcaaaatccccgggggggccatgtacgccgacgacaccgcgggctgggacacgcggattaccgaagacgacctgcacaacgaggaaaaaataacacagcagatggacccggagcaccgccagctcgcctccgcgatattcaagctcacctaccagaacaaggtggtgaaagtccagcggccgacgccgaaagggaccgtgatggacattatcagccgcaaggaccagcgtggctccggccaggttgggacttacggcctgaataccttcacaaacatggaggcccagctcgtgcgacagatggagggggagggcgtgctaagcaaggccgacctcgagaacccccaccttctggagaagaagatcacgcagtggctggagaccaagggggtggagcggctaaagcgcatggccatctccggcgacgactgcgtcgtgaagcccatcgacgatcggtttgcgaacgcgttactggccttgaacgatatgggcaaagttcgcaaggacatcccccagtggcagccgagcaaggggtggcacgactggcagcaggtccccttctgcagtcaccacttccacgagctgatcatgaaggacggccggaagctggtggtgccctgccgcccccaggacgaactcatcgggcgcgcccggatcagccagggagccgggtggtccctgaaggaaacggcctgcctgggcaaggcgtacgcgcagatgtggagcctcatgtattttcaccgccgggacctgcgcctggcctccaatgccatctgcagcgcggtcccggtgcactgggtgcccaccagccggacaacctggtccatccacgcgcaccaccagtggatgacaaccgaggacatgctcacggtctggaaccgcgtgtggatcgaggataacccctggatggaggacaagacccctgtaactacctgggaggacgtcccgtacctgggcaagcgggaggaccagtggtgcggctccctgatcggcctcacttctcgcgccacatgggcccagaacatcctgaccgccatacaacaggtgcggagcctgatcggggacgaggagttcctggactacatgccctccatgaagcgcttccggaaggaggaggagagcgagggcgcgatctggtag

SEQ ID NO: 26208 - RNA, 9873 nt, synthetic construct
  misc_feature 1..9873: note = derived and/or modified CDS sequence (opt11) from DENV-3__DQ675530__SS-prME
  source 1..9873: mol_type = other RNA
accagcttctgtctgatgatgatgctccccgctacactggccttccaccttacctcccgagacggcgagccgcggatgattgtagggaagaatgagcgtggcaaaagcctcttgtttaaaaccgcctccgggatcaatatgtgcaccctgatcgcgatggacctaggggaaatgtgcgacgacacggtcacgtacaaatgccccttgatcgctgaggtggagcccgaggacatcgactgctggtgcaacttgacttccacctgggtgacgtatggtacgtgcaaccaggccggggagcatcgccgagataagaggagcgtcgccctcgcgccccatgtggggatgggtctggacacccgaactcagacatggatgagcgccgagggagcctggagacaggtggagaaagtcgagacttgggccctgaggcacccggggtttacgatactcgctctgtttttagcccactatattggcacctcccccacgcagaaggtggtaatcttcatcctcttgatgctggtaactccctctatgaccatgcggtgcgtgggggtcggcaacagggattttgttgagggcctctccggtgccacctgggtcgacgttgtcctagagcacggcggatgcgtaactacgatggccaagaataagcccaccctggacatcgagctccagaagaccgaggcaacccagctggccacgctgcgtaaattatgcatcgagggaaaaattaccaacatcaccaccgacagccggtgtccgacgcagggcgaggccatactccccgaggagcaggaccaaaattacgtgtgcaagcacacttacgttgaccgggggtgggggaacgggtgtggcctgtttgggaagggctccctcgtaacgtgcgccaagtttcaatgcttagagccaatcgaggggaaggttgtccaatacgagaatttaaaatacaccgtgatcatcacagtgcacaccggggaccagcaccaggtcggaaatgacacacagggtgtgaccgtcgagataactcctcaggccagcaccgtggaggccgtgctaccggaatacgggaccctcggactggagtgcagcccccgaaccgggctagacttcaacgagatgatactgctgaccatgaaaaacaaagcgtggatggtccaccgacagtggttctttgacctccccctgccctggacgagcggagccaccaccgaaactccgacgtggaataggaaggagctactcgtgacctttaagaacgcccacgccaagaagcaagaggtggtagtgctgggtagccaagagggcgccatgcacaccgcgctgaccggggctacggagatacagaactctggcgggacctccatcttcgccggtcacctcaagtgccggctcaagatggacaagttagagttgaagggtatgagctacgcaatgtgtctgaacaccttcgtactgaagaaggaagtatccgaaacccagcacgggaccatactcatcaaggtggagtataagggcgaagacgccccttgcaagatccccttctccaccgaagatggtcaaggcaaggctcacaacggtcgcctgatcacagccaaccccgttgtcaccaagaaggaggagccggtaaacattgaggccgaaccgcccttcggggagagcaacatcgtgatcggcatcggggacaaggccctgaagatcaactggtacaagaagggctccagcatcgggaagatgttcgaagctacggctcgaggcgcacgcaggatggccatccttggcgacaccgcctgggacttcgggagtgtgggcggcgtgctcaatagcctgggcaaaatggtccaccagatcttcgggtccgcctatactgccctattttcaggcgtctcctggatcatgaaaataggcatcggggtgctcctgacatggatcggcctgaacagcaagaacacctccatgagcttcagctgcatcgtgatcgggatcatcaccctatacctgggtgcggtggttcaggccgacatggggtgcgttatcaactggaaaggcaaggagctgaagtgcgggagcgggatctttgtaaccaacgaagtacatacctggacggagcagtacaagttccaagccgactcgccgaagcgcctcgcgacggctatcgccggcgcctgggagaatggggtgtgcggcatcaggtcgaccacccgcatggagaatttactgtggaagcagatcgccaacgagctcaactacatcctgtgggaaaacaacatcaagctgacggtcgtcgtcggcgatattataggcgtcctagagcagggcaagaggaccctgaccccgcagcccatggaattaaagtactcctggaagacatgggggaaagcgaaaatcgtgacggccgagattcaaaattcctcctttatcatagacggcccgaataccccggagtgtccgagcgcctctagagcatggaacgtgtgggaggtcgaggactacgggttcggcgttttcacaaccaatatctggctcaagctgcgcgaaatgtacacccaatcctgcgaccatagactgatgagcgccgccatcaaggacgagcgtgccgtgcatgccgacatgggctactggatcgagtcccagaaaaacggctcctggaagctggagaaggcctccttcatagaagtcaagacctgtacgtggcccaagagccacacactgtggtccaacggcgtgctggagagcgacatgatcatcccaaagtccctggctgggccgataagccagcataaccaccggcccggctaccacacgcagacggccggaccttggcacctgggcaaacttgagttagactttaactactgcgaaggtaccaccgtggtcatcacagaaaactgtgggacgcgcggcccctccctccgaaccacgaccgtatctgggaaacttattcatgagtggtgctgccgcagttgcaccctcccgcccttacgttacatgggtgaagacgggtgctggtatggcatggagatccggcccattaacgagaaggaggagaatatggtgaagagtctggtctccgccgggtctgggaaagtggataacttcaccatgggcgtcctctgcctggctatactgtttgaggaggtcatgcgggggaagttcggcaagaagcatatgatcgtgggggtactcttcaccttcgttctattgctctccggccaaatcacctggcgggacatggcccataccttaatcatgataggcagcaatgcgtccgatcggatgggcatgggtgtaacctaccttgccctcatcgcgacttttaaaatccagcccttcctggccttggggttcttcctccgcaagttgacgagccgggagaacttgctcttgggcgtgggcttggccatggcaacgaccctgcagctgccggaggacatagagcaaatggccaatgggatcgccctaggcctcatgactctaaagctgatcacccagtttgagacgtatcaactctggaccgcgttagtaagtctaacctgctctaatactatctttacgctcactgtggcgtggcgcaccgccaccctaatactggccggggtcagtttactgccactgtgccagtcatcatccatgcgcaagaccgactggctcccgatgaccgtggccgctatgggggtcccaccgctgcccctgttcatattcagtctcaaggatacccctaagcgccgctcctggcccctgaacgagggggtcatggcggtgggcttagtgagcatcttggccagcagcctgctgcgcaacgatgtcccgatggccggcccgctcgtggccgggggcctgctgatagcatgctacgtgatcactggcacgtccgcagatctcacggttgagaaggccgctgacgtgacctgggaggaggaagccgagcaaacgggggtgagccacaacctgatgatcacggtcgatgatgacggcaccatgcggatcaaagacgacgagaccgaaaatatactgacggtgcttcttaagaccgctctactcattgtctccggaatcttcccctacagcatccctgcgacactcctggtctggcatacctggcagaagcagacccagaggtccggcgtgctgtgggatgtacccagtcccccggagacccaaaaggctgaactggaggagggggtctaccgtataaagcaacaaggcatcttcggtaaaacgcaagtgggcgtaggggtccagaaggagggggtgtttcacaccatgtggcatgttacccggggcgccgtactgacacacaacggcaagcgccttgagcctaactgggcgagtgtgaagaaggacttgatcagctacggcgggggctggcggctgagcgcccagtggcagaagggggaagaagttcaggtcatcgcggtggaaccaggcaagaacccgaagaatttccagactatgcccggtattttccagacaaccaccggcgagatcggagccatagcgctcgacttcaaaccggggacaagcggatcgccgatcataaaccgcgaaggcaaggttgtcgggctatacgggaatggtgtggtgaccaaaaacggtggctacgtttcaggcatcgcacagacaaacgcagaacccgatgggccgactccggagctggaggaagagatgttcaaaaagcgaaacctgacgatcatggacctacaccccggcagtgggaaaacccgaaagtatttacccgccatcgtgagggaggccatcaagcggcggctgcgcaccctcatcctggctccgacccgggtggtcgcggcggaaatggaagaggccctgaaggggttgccgattagataccagacgacggccaccaagtcggagcatactggccgggaaatagttgacctgatgtgccacgctacgttcaccatgagactcctcagccctgtgcgggtccccaactacaacctgattataatggacgaggcccacttcacagatcctgcgagcatagccgcgcgggggtacataagcacgcgggtgggtatgggcgaggccgccgcgatctttatgacggcaacgccgcctgggaccgccgaagcattcccccagtccaacgcgccaattcaggacgaagagagagacatcccagaacgctcctggaactccggcaatgagtggatcaccgactttgtagggaagacggtttggttcgtcccaagcataaaagccggaaacgacatcgctaactgcttgcggaaaaacgggaagaaggtcatccagctctcccgcaagaccttcgataccgaatatcagaaaacacgacttaacgattgggatttcgtcgtgacaaccgacatttcagagatgggcgccaactttaaagccgaccgcgtcattgacccacggcgctgcctgaaacccgtcatcctcacggatggcccggagagggtgatcctggcggggcccatgccagtgaccgccgccagtgcagcccagcgccggggacgcgtcgggcgaaacccgcagaaagagaacgatcagtacattttcacggggcagccgctgaacaacgacgaagaccatgcgcattggaccgaggccaaaatgcttctagacaatatcaacacccccgaaggaatcatcccggccctgttcgaaccggaacgcgaaaagagcgctgccatcgatggcgaatatcgtctcaagggcgagtcgaggaagacattcgtggagctgatgcggcgtggggacctgcctgtctggctcgcccacaaagttgcgagcgaaggcataaagtacaccgatcggaagtggtgcttcgatggagagcgtaacaaccagatccttgaggagaacatggacgtagagatctggacgaaggagggcgagcgcaagaaactgcgcccccgctggctcgacgcccggacatattcagacccccttgccctgaaggagtttaaagatttcgcggctgggagaaagagcatagcgctggatttagtgaccgagatcgggcgcgtgccttcccatctggcgcacagaacccgtaatgccttagacaacctggtgatgctgcacacttccgagcacggcggtcgcgcgtatcggcacgccgtcgaggagctccccgagaccatggagacactgcttctcctgggcctgatgatcctcctgaccgggggtgccatgctgtttcttataagcgggaaggggataggcaagacgtcaatcggcctgatctgcgtgattgtgagctccggaatgctttggatggccgacgtacccctccaatggatcgccagcgcaatcgtgctggagtttttcatgatggtgctgctcatccccgagccagaaaagcagcggacgccccaagacaaccagctggcctacgtcgtgatagggatcctcacccttgccgccatcgtggcagcgaacgaaatgggactactggagaccaccaagagagaccttgggatgagcaaagaacccggagtcgtgagccccacctcctacttagatgtggacctgcatccggcgagcgcctggacgctctacgccgttgcgaccacggtgatcacccccatgctgcgccataccatcgagaactcaaccgcgaacgtgagcctggccgcgatcgccaaccaggccgtcgtccttatgggcctggacaaagggtggcccatcagtaagatggacctgggcgtgcctctcctggccctggggtgctattcgcaagtcaaccccctcacgctgacagccgccgtcctgctcctggtaacccattacgcaattatcggacccggccttcaagcgaaagcaacccgagaggcgcagaagcgcaccgccgccgggatcatgaaaaaccccaccgtcgatggcataatgaccatcgatctcgaccccgtaatctacgattcaaagttcgagaagcagttaggtcaggtgatgctgcttgtcctgtgcgctgtgcagctgctcctaatgcggacatcatgggcgctgtgtgaggccctcacgcttgccaccggcccgattacaacactttgggagggctccccaggcaagttttggaatacgaccattgccgtttcgatggcgaacatcttccgcggttcttatctcgccggcgctggactggcgtttagcatcatgaagtccgtcgggactggacggcgcggaacaggcagccagggcgaaacactcggtgaaaagtggaaaaagaagctcaaccagctgagccggaaagagtttgacctgtacaagaagtccggcataaccgaggtggataggaccgaggcgaaagaggggctcaaaaggggtgagaccacgcatcatgccgtgagccgcggatccgcaaagctgcagtggttcgtcgaacgcaacatggttatccccgaaggtcgcgtgattgacctaggctgtggacgcggcgggtggagctactattgcgcgggcctcaaaaaggtcacggaggtgcgagggtacaccaaagggggccccggtcatgaggaaccggtgcccatgtcgacctacggctggaacatcgtcaagctgatgagcgggaaggacgtattctacttaccacccgaaaaatgcgacacactactgtgtgatatcggcgaatcgagcccgtcaccgacggtggaggaaagccgcaccatacgggtactgaagatggtcgagccctggctcaagaacaaccagttctgtatcaaagtgctcaacccttacatgccgaccgtcatcgaacaccttgagcgcctgcagcgtaagtacggcgggatgctcgtccgaaacccgctgtccagaaacagcacccacgaaatgtactggatcagcaacggcacagggaatatcgttagctccgtcaatatggtgagcagactgctcttaaaccgctttacaatgacccaccgtaggcccaccatcgagaaagacgtcgacctgggcgcgggcacgcgccatgttaacgctgagccagagacacccaacatggacgtgatcggcgagcggatcaagcgcatcaaagaggaacactctagcacatggcactatgacgatgagaacccttacaagacctgggcctaccacggctcttacgaagtcaaagctacgggttcagcaagctccatgatcaacggagttgtgaaactactgacgaagccctgggacgtagtaccgatggtaacccagatggcaatgaccgacacgaccccctttgggcagcagcgtgtgttcaaggagaaggtggacacccgcacaccccggcctatgcctggcacgagaaaggtgatggagataaccgcggagtggctctggcggaccctgggtagaaacaagaagccccgactgtgcacccgtgaggagtttacgaaaaaggtccgaacgaatgcagccatgggggccgtattcaccgaggagaaccaatgggactccgcgcgggctgccgtcgaggacgaggagttctggaagctggtggatcgagagcgggagttacacaagctaggcaagtgcgggagttgcgtgtacaatatgatgggcaagcgcgagaagaagctgggggagttcggaaaggccaagggcagccgggccatatggtacatgtggctcggtgctcgctacctggagttcgaggccctgggtttcctcaacgaggaccactggttctccagggagaatagctattccggggtggaaggggaggggttacacaagctgggttatatcctccgggacattagtaaaatccccggcggggccatgtatgccgacgatactgccggctgggacacgcggatcacggaagacgacctgcacaatgaagagaagatcacccagcagatggatcccgagcaccgacaactcgcgtccgccatattcaagttgacctatcaaaacaaggttgtgaaggtccaaaggccgacgcccaaggggaccgtgatggacatcattagcaggaaggatcagcggggaagcggccaggtcgggacctacggactgaacaccttcaccaacatggaagcgcagttagtccgccagatggaaggggagggcgtcctctcgaaagcagatctagagaacccgcaccttctcgagaagaaaatcacgcagtggctggaaaccaaaggggtggaacggctgaaacgcatggccatatccggggacgactgcgttgtcaagcctatcgatgaccggttcgcaaacgccttactcgccctaaacgacatgggcaaggtccgcaaggatatcccgcagtggcaacccagcaaaggatggcacgactggcagcaggtccctttctgctcccaccatttccacgagttgattatgaaggacggccggaaactggtcgtgccatgtcgcccgcaggacgagctgatcgggcgtgccagaatcagccagggagcaggctggtcgctcaaggagacagcttgcctgggaaaagcctacgcccaaatgtggtcactgatgtatttccaccgacgggacctgcgcctggcgtccaacgccatctgcagcgctgtgcccgttcactgggtgcccaccagcaggacaacctggtccatccatgcgcaccaccaatggatgaccacagaagacatgctgacggtttggaatcgggtttggattgaggacaacccctggatggaggataagactcctgtgaccacctgggaggacgtgccctacctgggaaagcgggaggaccagtggtgtgggagcctgataggtctgacgagtcgcgccacgtgggcgcaaaatatcctcaccgcgatccagcaagtccggagtttgatcggtgacgaggagttcctggactacatgccctccatgaagagattccgcaaggaggaggagagcgagggagccatctggtag

SEQ ID NO: 26209 - RNA, 9873 nt, synthetic construct
  misc_feature 1..9873: note = derived and/or modified CDS sequence (opt11) from DENV-3__DQ675533__SS-prME
  source 1..9873: mol_type = other RNA
acaagcctgtgcctcatgatgatcctgcccgctgccttagcgttccacctcacctcgcgggacggggagccccggatgatcgtggggaagaacgagcggggcaagagcctcctgttcaaaacggcaagcggtatcaacatgtgcaccctcatcgccatggacctgggtgagatgtgcgacgacaccgtgacctacaagtgcccacacatcaccgaggtggagcccgaggatatagactgctggtgtaacctgacaagcacctgggtaacctacgggacttgcaaccaagccggcgagcatcggcgcgacaagcggagcgtggccttagcgccccacgttggtatgggactggacacccgcacccagacctggatgagcgctgagggcgcctggcgccaggtggagaaggtcgagacgtgggccctgcgccatccaggattcacaattcttgcgctgttcctggctcactacatcggcacctccctcacccagaaagtggttatcttcatactgctgatgctcgtcacgcccagcatgaccatgcggtgcgtgggcgtgggcaatcgcgactttgtcgagggcctttccggggccacttgggtggacgtggtcctggaacacggcggttgcgtgacgacgatggccaagaacaagcccaccctcgacatcgagcttcagaagaccgaggccacacagctggcgacgctccggaagctgtgtatagaggggaagataaccaacatcaccaccgactcccgctgccccacgcagggcgaagccgtgctgccggaagagcaggaccagaactacgtctgtaagcacacctacgtggaccgggggtggggcaacgggtgcggactcttcgggaagggctccctggtgacctgcgcaaagttccagtgcctagagcccattgagggaaaggtcgtgcagtacgagaaccttaagtacaccgtgatcatcacggtccacacgggggatcagcaccaggtcggaaacgaaacccagggggtcaccgccgagatcacaccccaagccagcacccatgaggcgctgctacccgagtatggcaccctcggattggagtgctccccccgcaccggcctggatttcaacgagatgatcttgctcaccatgaaaaacaaggcctggatggtgcaccggcagtggttctttgaccttccccttccctgggccagcggagccacgaccgagaccccgacctggaaccgcaaggagctgttggtgacgttcaagaacgcacacgcaaagaagcaggaagtcgtcgtgctcgggagtcaggagggcgccatgcataccgcgttgaccggggccaccgagatccaaaactcaggcgggacgtccatcttcgccggccacctgaagtgtcgcctaaagatggacaagctggaactgaaggggatgagctacgcgatgtgcaccaacacctttgtcctcaagaaggaggtgtccgaaacccaacacggtacgatcctgatcaaagtggagtacaagggagaagatgccccgtgcaagatacccttctcaactgaagacgggcaggggaaggcccacaatggccgcctgatcaccgccaaccccgtcgtgaccaaaaaggaggagcccgtgaacattgaagcggagccgcctttcggggagagcaatatcgtgatcggaatcggggacaacgccttaaagatcaactggtacaaaaagggctcaagcatcgggaaaatgttcgaggctacggcccggggggccagacggatggccatcctgggcgacacagcgtgggacttcggtagtgtgggcggggtgctaaacagcctgggcaaaatggtccaccagatcttcggttccgcctacactgccctctttagcggcgtgtcctgggtcatgaagattggaataggggtcctgctgacctggatcggactcaacagcaagaacacgtccatgtcattctcctgcatagccatcggtataataaccctgtacctgggagcggtggtgcaagccgacatggggtgcgtgatcaactggaaaggcaaggagctcaagtgcggctctgggatctttgtgaccaacgaggtgcacacatggacggagcagtacaagttccaggccgactcccccaagcgcctggccaccgcgatcgctggcgcctgggagaacggggtctgtgggattaggagcaccacccggatggagaacctgctctggaaacagattgccaatgagctgaactacattctgtgggagaacaacatcaagctcacggtggtggtcggtgacacattgggcgtgttagaacagggtaagaggactctcacgccccagcctatggagttgaagtactcttggaaaacgtgggggaaggccaagattgttactgcggaaacccagaacagctccttcatcatagacggccccaataccccagagtgcccctcggcctcacgcgcatggaacgtctgggaggtggaggactacggtttcggcgtgttcaccaccaacatctggctgaagctgcgcgaggtctatacacagctgtgcgaccaccggctgatgagcgcggccgtaaaggatgagcgcgcggtccacgcagacatgggctactggatcgagagccaaaagaacgggtcttggaagttagagaaagcaagtctgatcgaggtcaagacctgcacctggccgaagtcccatacgctctggtcaaacggcgtgctcgagtccgacatgatcattccgaagagcctagccgggcccatctcccaacacaactatcgtccgggataccacacccagacggccgggccctggcacctgggtaagctcgagctggatttcaactactgcgagggcaccacggtggtcatcaccgaatcttgtgggacccgcggccccagtctgcggaccacgacagtgagcgggaaacttatccacgagtggtgctgccgcagttgtaccttgcccccactgcgatacatgggggaggacgggtgctggtacggcatggagatacgccccataagcgagaaagaggagaacatggtgaagtctttagtaagcgcgggttccgggaaggttgacaacttcaccatgggcgtgctgtgcctggccatcctcttcgaggaggttttgagagggaaattcggaaagaagcacatgattgcgggggtgttcttcacgtttgtgttactccttagcggccagatcacctggcgcgacatggcacataccctcatcatgatcggctccaacgccagcgaccggatggggatgggcgtcacctaccttgcactgatcgccacgttcaagatccagccctttctggccctcgggttcttcttacgtaagttgaccagtcgcgagaacctcctgttaggggtgggcctcgcgatggcgaccaccttgcagctgcccgaggacatcgagcaaatggccaatgggatcgctttaggcttaatggccctgaaattaatcacgcagtttgagacctaccagctgtggaccgccctggtgtccttgacctgctcaaacacgatattcaccctaaccgtcgcatggcgcaccgccacgctgatcctagccggagtgagtctcctgccggtctgccaaagctccagcatgcggaagaccgattggctccctatgactgttgccgccatgggtgtgccgcccttaccgctgctcatcttctccctgaaggacacccttaaacgccgcagctggcctctcaacgagggggttatggcggtgggcctggtgtccatcctggccagctccctcctacggaacgatgtccccatggcaggccccctggtggcaggtggcctcctcatcgcctgctacgtcatcacgggaaccagcgcggatctgacggtcgaaaaggcggccgacgtgacctgggaggaagaagccgagcagacgggcgttagccataacctcatgatcaccgtagatgacgatgggacgatgcgcatcaaggacgatgagacagagaatatcctgaccgttctgctcaagacggccctgctgatcgtgagcggcatcttcccgtactccatccccgcgaccctcctggtctggcatacctggcagaagcagacccagcggagcggcgtgctgtgggacgtgcccagccctcccgagacgcagaaggccgagctagaagagggggtctaccgcataaagcagcaaggcatcttcggaaagactcaggtgggcgtgggggtccaaaaggagggggtattccacacaatgtggcatgtgacccgaggggccgtgctgacgcacaacggcaagcgccttgaacccaactgggccagcgtgaagaaggatctgatttcctacggcgggggctggcggcttagcgcgcagtggcagaagggtgaagaggtgcaggtcattgcggtggagcctggcaagaaccccaagaacttccaaaccatgccgggaacgttccaaacgacaaccggggagatcggggccatagccttggactttaagcccgggaccagcggctccccgatcatcaaccgcgagggaaaggtggttgggctgtacggcaacggggtggtgaccaagaacggggggtacgtctccggtatcgcccagacgaacgcggagcccgacggccccactcccgagctcgaagaggagatgtttaagaaacgtaacttaaccatcatggacttgcaccccgggtccggcaaaacccgcaagtatctcccggccatcgtgcgggaggccatcaagcgccggctgcgaacactgatcttagcccccaccagggtagtcgccgcagagatggaggaggctctgaaagggctgccgattcgctaccagaccaccgcaacaaagtccgagcacaccggccgggaaattgtggacctcatgtgccacgccactttcaccatgcgcctgctttcacccgtacgagtcccgaactataatctcattataatggacgaggcacacttcacggaccccgcgagcatcgccgcacggggatacatctccactcgggtgggcatgggcgaggcggcggcgatcttcatgaccgccacgccgcccgggacggccgatgccttcccgcaaagcaacgcgcccatccaggacgaggagagggatatccccgagcgttcctggaacagcggcaatgagtggatcaccgattttgccggcaagacagtctggttcgtgcccagcatcaaagctggcaatgacatcgccaactgtctgcgcaagaacggcaagaaggtgattcagctgagccgaaagacattcgacacggagtaccagaagaccaagctcaacgattgggatttcgtggtcaccaccgacatctccgagatgggcgccaacttcaaggcggatcgggtgatcgacccgcgccggtgcctgaaacccgtcatcctgacggacggccccgaacgcgtgatcctcgccgggcccatgccggtgaccgccgccagcgccgcgcagcggcgcggcagggtcggtaggaacccccagaaagagaacgatcagtacattttcaccggccagcccctgaacaacgatgaggaccacgcgcactggacggaggccaagatgctgctcgataacattaatacccccgaggggataatcccggccctctttgagcccgagcgggaaaagtcagcggcaatcgacggcgagtaccgccttaagggcgagagccggaagacgttcgtggagctcatgcgccgaggggacctcccagtgtggctggcccacaaggtcgcctccgaggggatcaagtacaccgaccgaaagtggtgcttcgacggggagcggaacaaccaaatcctcgaggagaacatggacgttgagatctggactaaggagggcgagcgcaaaaagctccggccccgctggctggacgcccgaacatactccgaccccctcgcgttgaaggagttcaaagacttcgcagccggtcggaagagtatcgcactggacctcgtgacggagatcgggcgcgtccccagccatctggcccatcggacccgaaatgcgctggacaatttagtgatgcttcacacttctgaacacggcggtcgcgcctaccgccatgccgtggaggagctgcccgaaaccatggagacgctactgctactcggcctgatgatcctactcaccgggggagccatgctgttcctgatctccggcaaggggatcggtaagaccagcattgggctcatctgcgttatcgcctccagcggaatgctgtggatggcggaggtgccgttacaatggatcgcatccgccattgttctcgaattctttatgatggtgctgctgatccccgagcccgaaaaacagcgaaccccccaggacaaccagctcgcgtatgtggttattgggatcttaactctggccgcgatcatcgcggccaacgagatgggcctcctagaaaccaccaagagagacctgggcatgagcaaagaaccgggggtcgtttcacccaccagctacctcgacgttgacctgcatcccgcttccgcgtggactctgtacgccgtggctaccacagtaatcacccccatgttgagacacaccatcgaaaacagcaccgctaatgtgagcctggccgcgattgcaaaccaagcggttgtactgatgggtctcgacaagggatggccgatcagcaagatggacctgggcgtaccactcctcgcattgggctgctattctcaggtcaacccgctgaccctgaccgctgccgtgctgcttctcatcacgcattacgccatcatcggccccggcttgcaggccaaggccacccgggaggcccagaagaggacggcggccgggataatgaagaatccgaccgtggacggcatcatgacaatcgacctggaccccgtcatctacgactctaagttcgagaagcagctcggccaggtcatgctgctggtgctctgtgccgtccagctcttactcatgcggacctcctgggccctgtgtgaggcgctgaccctcgcgaccgggcccatcacgaccctttgggagggcagcccagggaagttctggaataccacgatcgccgtgtctatggcgaacatcttccggggtagctacttggccggggcgggtctcgccttctccataatgaagtccgtggggacgggcaagcgcggaaccgggagccagggcgagacgctgggtgagaagtggaagaaaaagctgaatcagctctcccggaaggagttcgacctgtacaagaagtccgggatcactgaggtcgaccgcaccgaggccaaggaagggctcaaaaggggagagacgacccaccacgccgtgtcacgcggcagcgccaagctccagtggttcgtggagcggaacatggtggtgccggagggacgcgtgatcgacctaggctgcgggcggggcggctggtcctactattgcgcgggcctgaagaaagtcaccgaagtccgcggatacaccaagggcgggcccgggcacgaggaacctgtgcccatgagcacgtacggatggaacatcgtcaagctgatgtcggggaaggacgtattctatctcccaccggagaagtgcgacacgctgctctgcgacatcggcgagagcagccccagcccgaccgtggaggaatcaagaaccatccgggtgctcaagatggtggagccgtggcttaagaataaccaattttgcatcaaggttctgaacccctacatgcctacagtcatcgagcatctcgagcgcctgcaaaggaaacacggagggatgctggtgcgtaatccactcagccgtaactcaactcacgagatgtactggatctcgaacgggaccgggaatatcgtgtccagcgtcaacatggtgtcccgccttttattgaaccggtttacaatgacgcaccgccggccaactatcgagaaggatgtggacttgggcgccggcacacgccacgtcaacgctgagcccgagacccccaacatggacgtgatcggggagcggatcaagcgtatcaaggaagagcacaacagcacgtggcactatgacgacgagaacccatacaagacctgggcataccacgggtcctacgaagtcaaggccacggggtcggcctcttccatgatcaatggagtggttaagctgctcacaaagccctgggacgtcgtgcccatggtcacgcaaatggccatgaccgacacgacccccttcgggcagcagcgggtcttcaaggagaaggtggacacgaggaccccgaggcccatgcccggtacccgcaaggtgatggaaataaccgccgagtggctatggcggacgttaggccgcaataagcggcctcggctctgcacccgcgaggagttcacgaagaaggttcgaaccaacgccgcgatgggggccgtattcacagaagagaaccagtgggattctgccaaggccgccgtggaagatgaggagttctggaagctggttgaccgcgagcgggagttgcacaagcttggcaagtgtgggtcatgcgtgtacaacatgatgggcaagcgcgagaagaagttgggggagttcggcaaggcaaagggcagccgagccatctggtacatgtggctcggcgcccgctacctcgagttcgaagccctgggctttcttaacgaagaccattggttctcccgggagaacagctactccggggtcgagggtgagggactccacaagttaggctatatactgcgcgacatcagcaagataccgggcggggccatgtacgcggatgacactgccggttgggatacccgaatcacggaagatgacttgcataacgaggagaagatcatccagcagatggaccccgaacaccgccagctggcaaacgcgattttcaaactgacgtaccagaataaggtagtgaaagtgcagcggcccacccccacagggactgtcatggatatcatctcccgcaaggaccaacggggcagcggacaagttggaacgtacggcctcaacacattcaccaacatggaggctcagctggtacgccagatggaaggtgagggagtccttactaaagccgacctcgagaacccgcatctcctggagaaaaagatcacccaatggctcgagacgaagggggtggagcggctgaagcgcatggccatatccggcgacgattgcgtggttaaacctatcgatgaccgatttgcaaatgcactgctcgccctgaacgatatgggcaaggtgcgcaaggatatcccccaatggcagccgagcaaggggtggcacgactggcagcaggtcccattctgctcccaccatttccatgagctgatcatgaaggatgggcgcaaactagtcgtcccctgccgcccccaggacgagctaattggcagagcacgcatttctcaaggggccgggtggtccctgcgcgagaccgcgtgcctcggcaaggcctacgcgcagatgtggagcctgatgtacttccaccggcgcgatctgcgactggcctccaatgccatctgcagcgccgttccagtacactgggtgccgacctcccgcacaacttggagcatccacgcacatcaccagtggatgaccacagaagacatgcttaccgtgtggaatcgtgtctggatagaagagaacccctggatggaagataagacgcccgtgaccacctgggagaatgtgccgtatctgggcaagcgcgaggaccagtggtgtggctctctcatcgggctgacctcccgggcgacctgggcgcagaacatcccgaccgccattcagcaggtccgctctctgatcgggaacgaggagttcctcgactacatgccctccatgaaacggttccgcaaggaagaggagagcgagggcgccatatggtag

SEQ ID NO: 26210 - RNA, 9873 nt, synthetic construct
  misc_feature 1..9873: note = derived and/or modified CDS sequence (opt11) from DENV-3__AY744677__SS-prME
  source 1..9873: mol_type = other RNA
accagcttatgcctcatgatgatgctccccgcgaccctggccttccacctcaccagccgggacggcgaaccccggatgatagtggggaaaaacgagcggggcaaaagcctgctgttcaaaaccgcgagcgggattaatatgtgcaccctcatcgccatggacctcggggagatgtgcgacgatactgtgacctacaagtgccccctgataaccgaggttgaacccgaggacatcgactgttggtgcaacctcacttcaacctgggtgacctacgggacctgcaaccaggccggcgagcatcggcgcgacaagcgaagcgtagccctggcgccccacgtcggcatggggctggatacccgcacccagacctggatgagcgcggagggcgcctggcggcaggtcgagaaggtagagacctgggcgttcaggcaccccgggttcacgatcctcgccctgttcctggcgcactacatcggcacctccctcacccagaaggtggtgatcttcatcctgctgatgctagtcacaccctcaatgactatgcggtgcgtgggtgtgggcaaccgagacttcgtcgagggcctgtccggcgccacttgggtggacgttgtcctggagcacggcgggtgcgtgacgaccatggcaaagaacaagccgaccctcgacattgagctgcagaagaccgaggcaacgcagctggccaccctccggaaactatgtattgagggcaagataaccaacgttaccacggatagccgctgcccgacccagggcgaggcgatactgccagaagaacaagaccagaactatgtgtgcaagcacacatatgtggaccgggggtggggcaatgggtgcggcctattcgggaaaggctctctggtgacctgcgccaagttccagtgcctggagagtatcgagggcaaggctgtccagcacgagaacctcaagtacaccgtaatcattactgtgcacacaggggatcagcaccaagtcggcaatgaaacgcaaggtgtgacggccgagatcactccccaggcctccaccgtcgaggcgattctgcccgagtacgggaccttagggctcgagtgcagcccccggactggtctggatttcaacgagatgatcctgctcaccatgaagaataaggcttggatggtgcatcggcagtggttcttcgacctaccgctgccttggacctcgggggcaaccaccgagacgcccacctggaacaagaaggagctcttggtgacgttcaagaacgcccacgccaagaagcaggaggtcgtagttctcgggtcccaggagggtgcgatgcacaccgcgctcacaggtgctaccgagatccaaacctccggcgggaccagcatcttcgccggccacctaaaatgccgacttaagatggataagctcgagctgaagggcatgtcatacgctatgtgtctcaatgcgttcgtgctcaagaaggaagtgagcgagacgcaacacggcaccattcttatcaaggtcgagtacaaaggcgaggacgccccctgcaagatccccttcagcaccgaagacgggcagggcaaagcccataacgggcgcctgatcacggccaacccgatcgtcacgaaaaaggaggagcccgtgaacattgaagcggaaccacccttcggggagtccaacatagtcatcggcatcggggacaaggcgctgaagatcaactggtacaagaagggcagctcaatcgggaagatgtttgaggccaccgcccgcggcgcacggcgcatggcaatcctcggcgacaccgcctgggacttcgggagcgtcggaggggtgctgaactccttgggaaagatggtgcaccagatcttcggtagcgcttacaccgccctcttctccggcgtcagctggatcatgaagatcggcatcggggttctgctgacgtggatcggcctgaacagcaagaacacaagcatgtcctttagttgcatagtcatcggtatcatcaccctctatctcggcgcagtcgtgcaagcggatatggggtgcgtgatcaactggaaaggcaaggagctcaaatgcggctcagggatcttcgtcaccaacgaggtgcatacgtggaccgagcagtacaagttccaggccgacagccccaaacggcttgccaccgccattgcaggggcgtgggagaatggggtgtgcggcatccgctccacaacgcgcatggagaatttactgtggaagcaaatcgccaacgagcttaactacattctgtgggagaataacattaaacttaccatagtggtgggggacgtgatcggtgtcctggagcagggcaagcggacactgacgccccagccaatggagctcaagtacagctggaagacgtgggggaaggctaaaatcgtgacagccgagacccagaactcctcctttatcatagacggaccgaacaccccggagtgcccttccgcgtcgcgcgcctggaacgtgtgggaagtcgaggactatgggttcggcgtgtttaccaccaacatatggctgaagctacgcgaaatgtacacccagctctgtgaccaccgcctaatgagcgccgccgtcaaggacgagcgggccgtccacgccgacatgggctactggattgagtcccaaaagaacggcagctggaaacttgagaaggcctctctaatagaagtgaagacttgtacctggccaaagagccacaccctatggtccaacggcgtgttagagtcagacatgatcatccccaagagcttagcagggcccataagtcagcacaactaccgacccggttaccacacccagaccgccggaccttggcacctgggcaagctcgagctcgattttaattactgcgagggaaccacggtcgtgataactgagaactgcgggacccggggcccctcactacgcacgacgacggttagcggcaagctgatccatgagtggtgttgccggtcatgcacgctgccacccctccgctacatgggggaggacggctgctggtacggcatggagatccggccgatcaacgaaaaagaggagaacatggtcaagagcctcgtgtctgcggggagcgggaaggcggacaattttaccatgggcgtactctgtctggccatattattcgaggaagtaatgcgcgggaagtttggcaaaaagcatatgatcgctggcgccctatttacgttcgtactgctgttgtccggccagataacctggcgggatatggcccacactttaattatgattggctctaacgcttccgaccgcatgggaatgggcgtaacttacttggccctcatcgccacgttcaagatccagccgttcctggccctaggcttcttcctccgtaagctgaccagccgcgagaacctactcctgggagtaggtctggcgatggcaaccaccctccagctgcccgaggacatcgagcagatggccaacggaatcgccctgggcctcatggccttaaaactgatcacgcagttcgagacctaccagttatggactgcgctcgtgagtctgatgtgctccaacaccatattcacgctgaccgtggcgtggcggaccgccaccctgatcctggccgtcatctcgctcttgcctgtgtgccagagctctagcatgcgcaagacggactggctgccgatgaccgtcgccgcaatgggggtcccgcccctccccctgttcatcttcagcctaaaagacaccctcaagcgacggtcgtggccgctgaacgagggagtgatggctgtcgggttggtgagcattctcgcgtccagctttctacgcaatgacgtgcccatggcgggccccctggttgccggagggctcctaattgcgtgctacgtgataacaggcacaagtgccgacctcaccgtggagaaggcggccgacgtcacttgggaagaggaggccgagcagaccggggtgtcgcacaacctcatgatcacggtggacgacgacggcaccatgcggatcaaggacgacgagaccgagaatattcttaccgtcctgctcaagactgcgcttctgattgtgtcggggatctttccctatagcattccggctacgctcctagtgtggcacacctggcaaaagcagacgcagaggtccggcgtcctgtgggacgtcccctccccgcccgagacccagaaggccgaactcgaggagggcgtgtatagaattaagcaacaggggatctttggcaagactcaggtgggggtaggcgtgcagaaagagggtgtcttccacaccatgtggcatgtgacccgcggcgctgtcctgacccacaatggcaagcggttagaaccgaactgggcgaatgtcaagaaagatctcatctcctacgggggagggtggaagttaagcgcccagtggcaaaaaggcgaggaggtccaagtgatcgccgtcgagcccgggaagaatcccaagaacttccaaacgatgcccggaatttttcagaccacgaccggggagatcggggccatcgccctggatttcaagcccggaacgtccgggtctcccatcatcaaccgcgaaggtaaggtggtgggcctatacggtaatggcgtcgtgactaaaaacgggggttacgtgagcgggatcgcccagaccaacgcagagccggacgggccgacccccgaactcgaggaggagatgttcaagaagcggaacctgacgataatggacctacaccccggctccgggaagacacgcaagtatctccccgccatcgtccgggaggctatcaagcgccggctgcgcaccttaatactcgccccgacccgggtggtcgccgcggagatggaagaggctctcaagggactgcccattcgctaccaaactactgccactaagagcgagcacacgggtcgggagatcgtcgacctcatgtgtcatgcaactttcaccatgcgcttactcagccccgtgcgggtacccaactacaacctcatcgtcatggacgaggcgcattttactgacccggcaagcatcgcagcccgcggctacatctccacccgggtcgggatgggcgaggcggccgccatcttcatgacggcaacgccgcccggcactgccgacgcattcccccaaagcaacgccccgatccaggatgaggagcgcgatattcccgaacggtcctggaactccgggaacgagtggatcacagacttcgccggcaagacggtgtggttcgtcccctccatcaaggccggcaatgacatcgccaactgcttacggaagaacggcaagaaggtgatccagctgtcacgcaagaccttcgacacagagtaccagaagaccaagctaaatgactgggacttcgtagtgacgaccgacatatccgagatgggggcgaacttcaaggccgaccgcgttatcgaccccagaaggtgccttaagccggtgatcctgacagacgggccggaacgcgtcatcctcgccggccctatgcccgtgacagtggccagtgccgcacagcggcgcgggcgggtcggccgcaacccgcagaaggagaatgatcagtacatcttcacagggcaacccctgaacaacgacgaggaccacgcccactggaccgaagctaagatgctgctcgacaacatcaacacccccgagggcattatccccgcactcttcgagccggagcgcgagaagtctgcggccatcgacggtgaataccgcctgaagggggagagcagaaagacgtttgtcgagctcatgaggcggggagacttaccagtctggctggcccacaaggttgcctccgaaggaatcaagtataccgacaggaagtggtgctttgacggcgagcggaataaccaaatactcgaggagaacatggacgtggagatctggacaaaggaaggtgagaagaagaagctacgacccagatggctggatgcccgaacgtactccgaccctctcgcgctcaaggagttcaaagattttgccgccgggcggaagtccattgccctggatctcgtcactgaaatcggacgcgtgccgagccacctggcgcaccgcacccggaatgctctggacaacctcgtgatgctgcatacttccgagcacgggggccgcgcttacaggcacgccgtcgaagaactgccagagaccatggagacgctactcctgcttgggctgatgatcctgctcaccggcggggccatgctgttcttaatctcggggaagggcatcggaaagacaagcataggcctcatttgcgtggtggcctctagcgggatgctgtggatggcggatgtccccctgcagtggatcgcctccgcgatagtgctcgagtttttcatgatggtcctgctgatcccggagcccgagaagcagcgcacgccacaggacaaccagctcgcctatgtagtgatcgggatcctgacactggccgcgatcgtggccgccaatgagatggggctactggagaccacgaaacgggacctgggtatgagcaaggagccaggcgtcgtgtcgccgacaagctatctcgacgtggacctgcaccccgcctccgcgtggaccctgtacgccgtcgcgactacggtgatcacccccatgctgcgccacacgatcgaaaacagcaccgccaacgtgtccctcgccgcgatcgccaaccaagccgtcgtcttgatgggcctcgacaagggctggcccatcagcaagatggacctgggtgtgccgctgctcgccctgggctgctactcccaggtcaacccacttacgctcaccgctgcggtgctgctgctcgtgacccactacgcgatcatcgggcccggactgcaggccaaagccactcgggaggcccagaaacgcacggcagccggcatcatgaagaatcccactgtggacgggatcatgaccatcgacctggacccggtgatctacgacagcaagttcgagaagcagctcggccaggtgatgctcctcgtcctctgcgccgtgcagctgctgctcatgcggaccagttgggccttctgcgaggcgctgacgctggccaccgggccgatcaccacattatgggagggctcgcccggtaaattctggaacacgaccatcgccgtatccatggccaacatcttccgcggttcatacctggccggtgcggggctggccttctccatcatgaagtccgtcggcaccgggaagcggggcaccggcagtcagggggagaccctcggcgagaagtggaagaaacgcctgaaccaactgtcacggaaggaatttgacctctacaagaaatccgggatcacagaggtagaccgaaccgaggccaaggagggcttgaagcgcggggagattacacaccacgccgtgtcacgtggcagcgccaagctgcagtggttcgtcgagcggaatatggtgatccccgagggacgcgtgatagacctcgggtgcggtcgcgggggctggtcctactactgcgcggggctgaagaaagtgacggaggtgcgcggctacacgaaaggagggccgggacacgaggagcccgtgcccatgagcacgtacgggtggaacatcgttaagctgatgtcaggcaaggacgtgttttacctcccgcccgagaaatgtgacaccctgctgtgcgacattggggagagctcccccagccccaccgtggaggagtcccggacgatccgggtccttaagatggtggagccctggctcaagaataatcagttctgcatcaaggtgctgaacccctacatgcccactgtcatcgagcacctggaacgcctacagcgcaagcacggcggtatgctggtgcgtaatcccttgtcgagaaattccacccacgaaatgtactggatcagcaatgggaccggcaacatcgtgtccagcgtcaacatggtgtccaggctgctgctgaaccggtttacgatgacgcacagacggcctaccatagagaaggatgtggacctcggggcgggcacccgccatgtcaatgcagagccggagacgccaaacatggacgtaatcggagagcggatccgccgtatcaaggaggaacacagctccacctggcactacgatgacgagaatccatacaagacatgggcctaccatgggtcctacgaggtcaaggccaccggttccgcgagcagcatgatcaacggcgtggtgaaactgctgacgaagccttgggacgtagtacccatggttacccagatggccatgaccgacaccacgcccttcggacagcagcgggtattcaaggagaaagtggatactcggacgccccggccgatgcccgggacgcgcaaggttatggagataacggccgagtggctatggcgcaccctgggccgtaataagagaccgcggctgtgcacccgcgaagagttcatcaagaaggtccgcaccaatgccgcgatgggcgccgtgttcacggaagagaaccagtgggactccgcgagggcggctgtggaggacgaggagttctggaagctcgttgacagagaacgggagctgcacaaactggggaagtgcggctcctgcgtgtacaacatgatgggaaagcgcgagaagaagctcggtgagttcggcaaggcgaagggctcccgagccatctggtacatgtggctaggcgctcggtatctggagttcgaagccttggggtttttaaacgaggatcattggttcagcagagaaaactcctacagcggcgtggagggggaaggcctgcacaagctcggctacatcctgcgcgacatctccaagatccccggcggcgccatgtacgcggacgacaccgccgggtgggacacccggatcacagaggacgaccttcacaacgaggagaagatcacgcagcagatggatccggaacaccgtcagctcgccaacgccatcttcaagctgacttaccagaacaaggtagtgaaagtgcagcggccaactcccaagggcaccgtaatggatattatcagtcgcaaggaccagagaggttccggccaggtgggcacatatgggctgaacactttcaccaacatggaggcgcagctcatccggcagatggagggcgaaggggtgctgagcaaggcggacctggagaacccccatctcctggagaagaaggtcacccagtggctggagacaaagggcgtggagcggctaaagcgcatggctatctccggagacgactgtgtggttaaaccaatcgacgacagattcgccaacgctctactggccctcaatgacatggggaaggtgcgcaaggacatcccccaatggcagcctagcaaaggttggcatgactggcagcaggtccccttctgctcccatcatttccatgagctcattatgaaggacgggcggaaactggtcgtgccgtgccgcccccaggacgagctcattggccgggctcgaatcagccagggggccggatggtccctgcgcgagacggcatgcctcgggaaggcctacgcgcagatgtgggccctcatgtatttccaccgccgcgacctgcggctggccagcaacgcgatctgttccgccgtacccgtccactgggtacccaccagccgcaccacctggtccatccatgcgcatcaccagtggatgacgaccgaggatatgttaaccgtgtggaacagagtctggatcgaggacaacccatggatggaggacaagacccccgtaacgacctgggaagacgtgccgtacctgggcaaacgcgaggaccagtggtgcgggagcctgatcgggttgaccagccgggcgacctgggcccagaacatactgacggccatccagcaggtacgttcactgatcggcaacgaggagttcctcgactatatgccctctatgaaacggttccggaaagaggaggagtccgagggagctatctggtag

SEQ ID NO: 26211 - RNA, 9873 nt, synthetic construct
  misc_feature 1..9873: note = derived and/or modified CDS sequence (opt11) from DENV-3__AY744678__SS-prME
  source 1..9873: mol_type = other RNA
acgagtctgtgcttaatgatgatgctgcccgccaccctggccttccacctcactagccgcgacggcgagcccagaatgatcgtagggaaaaacgagagaggcaagagcctgctgtttaagaccgccagtggaatcaacatgtgcaccctcatcgccatggatctgggcgagatgtgcgatgacaccgtgacgtacaaatgccctctgatcacagaggtggagcccgaggacatcgactgctggtgcaatctcaccagcacctgggtgacctacggcacctgcaaccaggccggcgagcaccggcgcgacaagcggagcgtggccctggcgccccacgtgggaatgggcctggacacgcgcacccagacctggatgtctgcggagggcgcctggcgccaggtcgagaaggtcgagacatgggccttccgccaccccgggttcaccatcctcgccctgttcctggcacactatatcggcacgtcactcacccagaaggtggtgatcttcatcctgctaatgctcgtgacccccagcatgaccatgcggtgcgtgggggtgggaaaccgggactttgtagagggcctgagcggggccacttgggtggacgtcgtactggaacacggcgggtgcgtgacgaccatggcaaagaacaagccgaccctcgatatcgaactgcagaagacggaggccacgcagctggccacactcagaaagctgtgcatcgaaggcaagatcaccaacgtgaccacggacagccgctgcccaacccagggcgaggcgattctgcccgaagaacaggaccagaactacgtctgcaagcatacctacgtggaccgggggtggggcaacgggtgcggcctctttgggaagggctccctggtgacttgcgccaagttccagtgcctggagagcatcgaaggaaaggccgtacagcacgagaacctcaagtacacggtgataattacggtgcacaccggagaccaacaccaggtcggcaacgagacccagggggtcacggccgagatcacgccccaagccagcaccgtcgaggcgatactgcccgagtacgggaccctggggctcgagtgtagcccccgcaccggcctggacttcaacgagatgatattgctcacgatgaagaacaaggcctggatggtccaccggcagtggtttttcgatctgccgcttccctggacctcaggggccaccaccgagacgcctacctggaacaagaaagagctcctggtgacttttaagaacgcccatgccaagaagcaggaagtcgtcgtgctggggagccaggagggcgctatgcacaccgcgttgacgggggccaccgagattcaaacctcgggcgggacaagcatcttcgccggccaccttaaatgccgcctgaagatggacaagctcgagctgaagggcatgtcctacgctatgtgcctgaacgcgttcgtgctcaagaaagaggtctcggagacgcagcacgggaccattctgataaaggtagagtacaaaggcgaggatgccccttgcaagatcccgtttagcaccgaggacgggcagggaaaggcacataacggccggctcatcaccgcgaaccccatcgtcacgaagaaggaggagccagtgaacatcgaggcggaacccccgttcggggagtccaacattgtgatcggcatcggtgacaaggccctcaaaatcaactggtacaagaagggcagttccatcgggaagatgtttgaagcaaccgcccgcggcgcccggcgcatggcgatcctcggcgacacagcctgggacttcgggtcagtcggcggggtgctgaactccctgggcaagatggtgcaccagatcttcgggagcgcctacaccgccctcttctctggcgtcagctggatcatgaagatcggaattggggtgctgctcacgtggatcgggctcaactccaagaacaccagcatgtccttctcttgcattgtaatcgggataatcaccctgtacttaggtgccgtcgttcaggcggacatggggtgcgtcatcaactggaagggcaaggagctcaagtgcggctccgggatcttcgtcaccaatgaggtgcacacgtggaccgagcagtacaagttccaggccgacagccccaagcgccttgccaccgccatcgccggcgcgtgggagaacggtgtgtgcggtatccgatccaccacgcgcatggagaacctgctctggaaacagatcgccaacgagctgaactacatcctgtgggagaacaacatcaagctcaccatcgtcgtaggggacgtgatcggcgtcctggaacagggcaagcggaccctcacgccgcagcccatggagcttaagtacagctggaagacgtgggggaaggccaagatcgtgacggccgagacccagaactccagcttcatcatcgacggccccaacactcccgagtgtccctccgctagccgagcctggaacgtgtgggaggtcgaggattacgggttcggcgtgttcacgaccaacatctggctcaagctgcgggagatgtatacccagctctgtgaccaccgcctgatgagcgccgccgtgaaggacgagagagccgtccacgccgacatgggctactggatcgagtcccagaagaacgggagctggaagctggagaaggcctccctaatcgaggttaagacctgcacgtggcccaagagccacacgctgtggtccaatggagtgctcgagagcgacatgatcatcccgaagtccctggccgggcccatcagtcagcacaactaccgccccggctaccacacacagaccgccggtccgtggcacctgggcaagctcgaactcgacttcaactactgcgagggcaccacggtcgtaatcacagagaactgcgggactcggggcccatccctgcgaaccacgaccgtgagcgggaagctgatccacgagtggtgctgccgttcctgcaccctgccgccgctccgctacatgggcgaggacgggtgctggtacggcatggagatccgtcccataaatgagaaggaggagaacatggtcaagagcctggtgtccgccggcagcgggaaggcggacaacttcacgatgggcgtgctctgcctggccatcctgttcgaggaggtcatgcgcggcaagttcggcaagaagcacatgatagccggggccctcttcacgttcgttctgctgttatccggccagatcacctggcgggatatggcccacaccctgatcatgatcggcagcaacgcttcagaccgcatgggtatgggtgttacctacctggccctcatcgccacgttcaagatccagcccttcctggccctggggttcttcttgaggaaactgaccagccgcgagaacctgctcctgggcgtcggcctggcgatggccaccaccttgcagttacccgaagacatcgagcagatggccaacgggatcgccctgggtctcatggccctgaagctgatcacgcagttcgagacctaccagctctggacggcgctggttagtctgatgtgctccaatactatctttaccctcaccgtagcctggcggaccgccaccctgatactggccgtcatcagcctgttacccgtttgccagtccagctccatgcgcaagacggactggctgccgatgaccgtggctgcgatgggggtgccgcccctccccctgttcatcttcagcctgaaggataccctcaaacggcgctcctggcctctgaacgagggcgtgatggccgtcgggctggtgtctatcctcgcctccagctttctgcgcaacgacgtgcccatggccggccccctggtcgccggcgggctcctgatcgcatgctacgtgatcaccgggacgtccgccgacctgaccgtggagaaggcagccgacgtaacctgggaggaagaggccgaacagaccggggtcagccacaacctcatgattacagtggacgacgacggcaccatgcggataaaggacgacgaaaccgagaacattctgaccgtgctgctcaagaccgcgctgctgatcgtgtccgggatcttcccatacagcatacccgccaccctcctggtgtggcacacctggcagaagcagacccagcgctccggcgtcctgtgggacgtgccctccccacccgagacacagaaggccgagctggaggagggggtgtaccggatcaagcagcaggggatcttcggcaagacgcaggtcggggtgggcgtgcagaaggagggggtcttccacactatgtggcacgtgacccgcggcgccgtgctgacgcacaacgggaagcggctggaaccgaactgggcgaacgtcaaaaaggacctaatctcctacgggggaggctggaagctgagcgcccagtggcagaagggcgaggaggtacaggttatcgcggtcgagcccgggaagaaccccaagaactttcagacgatgcccggtatcttccagaccactaccggcgagatcggggcaatagccctcgacttcaagcctggtacttccggtagccccatcatcaaccgcgagggcaaggtcgtgggtttatacgggaacggcgtcgtgacgaagaacgggggctacgtgtccgggatcgctcagacaaacgccgaaccggacggcccgacccccgagcttgaggaggagatgttcaagaagcgtaacctgacgatcatggaccttcaccccggctccgggaagacccgcaagtaccttcccgccatcgtccgggaggccatcaagcgccgcctgcgcaccctgatcctcgcaccaacccgggtggtggcggctgagatggaggaggctctgaaaggcctgcccatccgctaccagacgaccgccaccaaaagcgaacacaccgggcgggagatcgtcgacctcatgtgccacgccacgttcaccatgcgcctgctgtcccccgtacgggtgcccaactacaacctcatcgtcatggacgaggcgcacttcaccgacccggccagcatagcagcccgcggctacatatccacccgggtggggatgggcgaggcggccgcaatcttcatgacggccaccccgcccggcaccgccgacgcgttcccccagagcaacgccccgatccaggacgaggagcgcgacatccccgagcggtcctggaacagcgggaacgagtggatcaccgacttcgccggcaaaacggtatggttcgtcccctccatcaaggccgggaacgacatagccaattgtctgagaaagaacggcaagaaggtgatccagctgagccgcaagaccttcgacaccgagtaccagaagactaagctcaacgactgggacttcgtggtcacgactgacatctcagaaatgggggcgaatttcaaggccgaccgggtaatcgacccccgtcggtgcctgaagccggtgatcctgaccgacggccccgagcgcgtcatcctagccggtcccatgcccgtcactgtggcctccgccgcgcagcggcgcgggcgggtcggccgcaacccgcagaaggagaacgaccagtacatctttacggggcagccccttaacaacgatgaagaccacgcccactggaccgaggccaagatgctgctcgacaacatcaacacacccgagggcataatccccgccctgtttgagccggagcgggagaagtccgcggccatcgacggggagtaccgtctgaagggcgaaagccggaagaccttcgtggaactcatgcgccggggcgacctgcccgtgtggctagcccacaaagtcgcttccgaggggatcaagtacaccgaccgcaagtggtgcttcgacggcgagcggaacaaccagatcctcgaagagaacatggacgtggagatctggacaaaggagggggagaagaaaaagctgaggccccggtggctggacgcgcgcacttactccgaccccctcgcgctgaaggagtttaaggacttcgccgccggccggaaatcgatagccctggacctcgtcacagagataggccgcgtgccgagccacctggcccacaggacccggaacgcgctggacaacctcgtgatgctgcacacgtccgagcacgggggccgcgcctaccggcacgccgtcgaggagctgcccgagaccatggagaccctcctgctgctcgggctaatgatcctgctcaccggcggcgccatgctgttcctgatcagcggcaaaggcattgggaaaacgagcattggcctcatctgcgtggtggccagcagcgggatgctgtggatggcagacgtccccctgcagtggatcgcctcggccatcgtcctcgaatttttcatgatggtgttgctgatcccggagcccgaaaagcagcgcacgccccaggacaaccagctcgcctacgttgtgatcggcattctgaccctggccgctatcgtggccgccaacgagatgggattacttgagaccacgaagagagacctgggcatgagcaaagagcccggcgtcgtgtcaccgaccagctacctagacgtggacctgcaccccgcatctgcgtggacgctgtacgccgtcgccaccacagtgatcacccccatgctccgccacaccatagagaacagcaccgccaacgtgtctctggccgcgattgcgaaccaggccgtagtgttaatggggctcgacaagggctggcccatcagcaagatggacctgggggtgccgctcctagccctgggctgctacagtcaggtcaatccgctgactctcaccgccgctgtgctgctgttagtcacccactacgctatcattgggcccggcctacaggccaaggctacccgggaggcccagaagcgcacggcggccggcatcatgaagaaccccactgtagacgggatcatgactatcgacctggacccggtgatctacgacagcaaattcgagaagcagctcggccaagtaatgctgctggtcctctgcgccgtgcagctgctgttaatgcgcaccagctgggccttctgcgaagcgctgacgctggccacggggcccatcaccaccctctgggaaggcagccccggcaagttctggaacacgacgatcgccgtgtccatggccaacatcttccgcggcagctacctggccggcgcgggactggccttctccatcatgaagtccgtcgggaccggtaagcggggcaccggttcccaaggggagacgttaggcgagaagtggaaaaagaagctgaaccagctatcccgcaaggagttcgacctctacaagaagtccgggatcaccgaggtggaccggaccgaggccaaggagggcctgaaacgcggggaaatcacccaccatgccgtgtctcggggtagcgccaaactgcagtggttcgtggagcgcaacatggtgatccccgaaggccgggtgatcgacctcgggtgcggccgcgggggctggtcctactattgcgcggggcttaaaaaggtcaccgaggtgagagggtacaccaagggcgggccgggccatgaggagcccgtgcccatgagcacctacgggtggaacatcgtcaagctgatgtcgggcaaggacgtgttctacctcccgcccgagaagtgtgacaccctgttatgcgacatcggggagtcatcccccagccccaccgtggaagagtcccgcacgattcgggtcctgaagatggtggaaccctggctcaagaacaaccagttctgcatcaaggtgctgaacccctatatgcccaccgtcatcgagcacctggagcgcctgcagcgcaaacacggcggcatgctggtgcgaaaccccttgagccgcaactccacccacgagatgtactggatcagcaacgggaccggaaacatcgtgtccagcgtcaacatggtgtcccgtttactgctgaaccgcttcacgatgacgcaccggcgccccaccatcgagaaggacgtggacctcggggcaggcacccggcatgtcaatgccgagccggagacgcccaacatggacgtgatcggagagaggatccggcgcataaaggaggagcacagctccacgtggcactatgacgacgagaacccctacaagacctgggcgtatcacgggagctacgaggtcaaggccaccggatccgcgagcagcatgataaacggagtggtcaagctgctgaccaagccttgggacgtcgtgcccatggtgacgcagatggccatgactgacaccacgccctttggccagcagcgggtcttcaaagagaaggtggacaccaggacgcctcgcccgatgcccgggacccgcaaggtgatggaaataacggccgagtggctttggcggaccctgggccggaataagcggccccgcctgtgcacgcgggaggagttcatcaagaaggtgcgcactaacgccgcgatgggcgcggtgttcactgaggagaaccagtgggattctgcccgagccgctgtggaggacgaggaattttggaagctcgtcgaccgggagcgcgagctgcacaagctggggaagtgcggcagctgcgtgtacaatatgatgggaaagcgggaaaagaagctcggcgagtttgggaaagcgaagggctcccgcgccatctggtatatgtggctgggcgcccggtacctggagtttgaagccttgggtttcctgaatgaggaccactggttcagccgcgagaactcatacagcggcgtagagggcgagggcctacacaagttggggtatatcctgcgggacattagcaagatccccggcggcgccatgtacgcagacgacacggccgggtgggacacccgtatcaccgaggacgacctgcataacgaggagaagataacgcagcagatggacccggagcatcggcagctcgccaacgccatcttcaagctgacctaccagaacaaggtcgtgaaggtgcagcgcccaaccccgaagggcaccgttatggacatcatctcgcggaaggaccagcgcggttccggccaggtcggcacgtacggcctgaacaccttcaccaacatggaggcccagttgatccgacaaatggagggggagggggtgttgagcaaggcggacctggagaaccctcatctcctggagaagaaagtcacccagtggctggagaccaagggcgtggagcgcctcaaacggatggccatatccggggacgactgcgtggtcaagccgatcgatgacagattcgccagcgccctgctggccctcaacgatatgggcaaggtgcggaaggacatcccgcagtggcagccctccaagggatggcacgactggcagcaggtacccttctgtagccaccacttccacgagctgatcatgaaggatgggcgcaagctggtcgtgccgtgccgtccccaggacgaactcatcggccgcgcgcggatctcccagggcgccggctggagtctgcgcgaaacggcctgcctggggaaggcctacgcgcagatgtgggccctcatgtacttccaccgccgggacctgagactcgcctccaacgcaatctgtagcgctgtgcccgtccactgggtgccgacctcccggaccacttggagcatccacgcgcaccaccagtggatgacgacggaggatatgctcaccgtgtggaaccgcgtctggatcgaggacaacccgtggatggaggacaagacccccgtgactacctgggaggacgtgccctacctgggcaaacgggaggaccagtggtgcggcagcctgatcggtctcacttcgagagccacctgggcccagaacatcttaacggccatccagcaggtccgcagcctgatcggcaatgaggagttcctcgactatatgccttccatgaaacgcttccggaaagaggaggagtctgagggggccatctggtga

SEQ ID NO: 26212 - RNA, 9873 nt, synthetic construct
  misc_feature 1..9873: note = derived and/or modified CDS sequence (opt11) from DENV-3__AY744679__SS-prME
  source 1..9873: mol_type = other RNA
accagcctgtgtcttatgatgatgcttcccgccaccctggccttccatctaacgagtcgggatggggagccgcggatgatcgtcgggaagaacgagcgtggcaagagcttactgttcaagactgccagcgggattaacatgtgcaccctcatagcgatggatctgggggagatgtgtgacgataccgtgacatataagtgccccctaatcacggaggtggagccggaggacatcgactgctggtgtaacctcaccagcacctgggtgacctatgggacatgcaaccaggccggcgagcaccggcgcgacaaacggagcgtcgcactggctccccatgttggtatggggctggatactcgaacccagacctggatgagcgccgagggtgcctggcgccaggtggagaaggtagagacctgggccttcaggcaccctggattcaccatccttgccctgttccttgcccactacatcggaacctcgctcacgcagaaagtggtaatattcatcttactaatgcttgtcacccccagcatgaccatgcgatgtgtgggggtgggcaaccgcgattttgtcgaagggctctccggggccacctgggtggacgttgtcttggagcacggcggctgcgtaaccacgatggctaagaacaagcccacgctcgacatcgagctgcagaagaccgaggccacacagctggccacccttcggaagctgtgcattgaaggcaagatcaccaacgtgaccacggactctagatgccctacccagggagaagcgatcctgcccgaggagcaggaccaaaattatgtatgcaagcacacctacgttgaccgggggtggggtaacggttgcggattattcgggaagggctccttggtaacctgcgcaaagttccagtgtctcgaatcaatcgagggcaaggtggtgcagcacgagaatctgaaatacacggtgattataaccgtccacacaggcgaccagcatcaggttgggaacgagacccagggggtcaccgccgaaattacgccccaggcctccacagtggaagccatcttgcccgaatacggcaccctggggctcgaatgtagccccaggacagggctggacttcaatgagatgatcctgctcacgatgaaaaataaggcgtggatggtgcaccgtcagtggttcttcgacctgccgctgccttggacgtccggcgctacaaccgagacccccacatggaacaagaaggagctactggtcacattcaagaacgcccatgcgaagaaacaggaggtcgtggtcctggggtctcaagaaggcgccatgcataccgctctcacgggagcgacagagatccagacatccggtgggacgagcattttcgccggccatctgaaatgccgcctgaagatggacaagctcgaactgaagggcatgtcctacgccatgtgtttgaatgcgttcgtgttgaagaaagaggtgtcagagacgcagcacggtacgatcttgatcaaggtcgagtataaaggcgaggacgcgccctgcaagatccccttctcgaccgaagacggacagggcaaagctcataacgggcggctgatcaccgccaaccccatcgttacgaagaaggaggagcccgtgaatatagaggccgaaccaccgttcggggaatcgaacattgtcattggaatcggagacaaggcgctgaaaatcaattggtacaagaaagggtcatccataggcaaaatgttcgaggccacggcccgcggcgcccggcgcatggcgatcctcggtgataccgcatgggactttgggagcgtaggaggggtgctcaattccctaggcaaaatggtgcatcagattttcggcagcgcctacaccgccctcttctccggggtgagctggattatgaagatcggcataggggtgctgcttacgtggatcggacttaactcgaaaaacacgagcatgtccttctcttgtattgtcatcggcataatcacactgtatttaggcgctgtagtgcaggccgacatgggttgcgtaatcaactggaagggccaggaacttaagtgcggaagtggcatcttcgtgaccaatgaggtgcacacgtggaccgagcagtataagttccaggcggacagcccaaagcggctggcgactgccatcgccggggcatgggagaacggggtttgcggaatccggtccaccacgcggatggagaaccttctctggaaacagatcgcgaacgagttgaactacattctatgggagaacaatatcaagctcacagtggtcgtcggggatgtaatcggcgtgctcgagcagggcaagcggacccttacaccacagccaatggagttaaagtactcttggaaaacgtggggtaaggcaaaaattgtcactgccgaaactcagaatagctcattcatcatcgacggtccgaatacaccagagtgcccctccgccagcagggcgtggaacgtgtgggaggttgaggactatgggttcggcgtctttactacaaatatttggctgaagctgcgggagatgtatacccagctctgcgaccatcgcctgatgtcggccgccgtaaaggacgagcgggcggtgcacgctgatatgggctactggatcgagtctcagaaaaacggtagttggaagttagagaaggcctccctaatcgaggtcaagacctgcacctggcccaagagccacaccctgtggtccaacggcgtgctggagagcgatatgatcatcccgaagtccctcgccgggcccatcagccagcacaactatcgccccggttaccacacccagaccgccgggccgtggcacctgggcaagctggagctcgacttcaactactgtgaaggtaccacagtcgtcatcaccgaaaactgtgggacgaggggaccctcactacgaactacgacggtgagcggtaaactcattcacgagtggtgctgccggtcctgtaccctgccgcccctcagatacatgggagaggacgggtgttggtacggcatggagatccgcccgatcaacgagaaggaggagaacatggtcaagagtctggtttccgctggtagcgggaaggctgacaatttcacaatgggcgttctttgtctggctatcctgtttgaagaggtcatgcgcggtaagttcggcaagaagcacatgatcgctggtgcactcttcacgttcgtcctgctgttatccggccagatcacctggcgggacatggcccacaccctgattatgattggatctaacgcgtccgaccgcatgggaatgggcgttacctacctggcgctcatcgcaactttcaaaattcaacccttcctagccctggggttctttctccggaaactgaccagcagggagaacctgctcctaggtgtgggcctggcgatggcgaccaccctccaactgcctgaggatatcgagcaaatggctaacggcatcgcccttggcctcatggccctgaaactcatcacgcagttcgagacctaccagctctggacggcccttgtctccctcatgtgttccaataccatcttcacgctgaccgtcgcatggcgaacggccacactcattctggccgtgatctcgctcctacccgtctgccagtccagctcgatgcgcaagacggattggctgccaatgactgttgctgccatgggggtgccgccccttccccttttcatcttcagcctgaaggacacgctcaagcggcgcagttggccgctgaacgaaggcgtgatggccgtagggctagttagcatcctcgcttcctctttcctgcgcaacgacgtgcccatggccggacccttggtagcaggcggcctcctgatcgcatgctacgtcatcactggcacgtccgcggacctgaccgtggaaaaggctgccgacgtcacctgggaggaagaagcggagcagaccggcgtaagccacaacctcatgattacagtagacgacgacggtacaatgaggataaaagacgacgagaccgaaaacatcctgaccgtgctgctcaagacagccctgttgatcgtctccggtatcttcccctactcgatcccagcaacgctcctggtttggcacacctggcagaagcagacccagcgctccggagtcctgtgggacgtcccatccccgccggaaacccaaaaggccgaactggaagaaggcgtgtataggattaaacagcagggtatcttcggcaagacccaagtaggggttggtgtacagaaggaaggagtcttccacacgatgtggcatgttacccgcggcgccgtgctgacccataatggcaaacgtctggagccgaattgggctaacgtgaagaaggacctaatctcgtatgggggcgggtggaaactgagcgcgcagtggcagaaaggtgaggaggtccaggtcattgctgtcgagcccgggaagaaccccaagaatttccaaacaatgcccggcatcttccagaccactactggcgagatcggggccatcgccctagacttcaagccggggacgtcgggttccccaatcattaaccgcgagggcaaggtcgtcggcctgtacgggaacggcgtggtaactaaaaacgggggctatgtcagcggcatcgcccagaccaacgcggaacccgacggcccgacccccgagctggaggaagagatgttcaagaagcgcaaccttacgatcatggacctgcaccccgggtccgggaagaccagaaagtacctccccgccatcgtgcgggaggccataaagcggcgcctgagaacccttatcctcgccccaactagagttgttgccgcggagatggaggaggctctgaagggtctgcccatcaggtaccagacaaccgccactaagtcggagcacaccggacgggaaatcgtagatttgatgtgccatgccacgttcaccatgcgcctactgtccccagtaagagtgcccaattacaacctcatcgtcatggacgaggcccacttcaccgatcctgcttctatcgccgccaggggatacatctccaccagagtcggtatgggggaagccgctgctatcttcatgacggccacaccgcccggcaccgccgacgccttcccacagagcaacgctccgatccaagacgaggaacgcgatatcccagaacggtcctggaactctgggaacgaatggatcacagacttcgcgggcaagacggtctggttcgtcccctcaattaaggccggcaacgatattgccaactgcctgcgcaagaatgggaaaaaggtcatccaactgtctaggaagacgttcgacactgaataccagaagaccaaacttaacgactgggacttcgtggttacgaccgacatttcggagatgggggccaacttcaaggcagaccgcgtaattgacccccgccggtgtctgaagccggtaatcctgactgacgggcccgaacgggtgattttagccggcccaatgcccgtcaccgtggcgtcggccgcccagagacgggggagggtcggccgcaacccgcagaaagagaacgaccagtacatctttacggggcagccactgaacaacgacgaggaccacgcgcactggacagaggctaagatgctgctcgacaacatcaacactccagagggaataatcccggcattattcgagccggagcgggagaagtccgccgcgatcgacggggagtatcgcctgaaaggcgagtcccggaaaaccttcgtcgagcttatgcgccgaggtgatctgcccgtgtggttggcacacaaggtcgcctccgagggtataaagtacaccgaccgtaagtggtgcttcgacggcgagcggaacaaccagatcctggaggaaaacatggacgtggagatctggacgaaggaaggggagaagaaaaagctgcgcccccggtggctagacgcccgtacatacagcgaccccttagccctgaaggagtttaaggacttcgcggccggcagaaaatcaatcgcactggacctcgtgaccgagatcggccgcgtcccgagccacctggcgcacaggacccgcaacgccctggataaccttgtgatgctgcatacgtctgagcacgggggccgagcataccgtcacgctgtggaggagctaccggagaccatggaaaccctcctgctactgggtctgatgatcctgctcaccggcggcgccatgctgtttctcatatcaggcaagggtatcgggaaaaccagcataggcctcatctgcgtcgtggcctccagcgggatgctctggatggccgacgtgcccctgcaatggatcgcgtccgccatagtcctagagttctttatgatggtgttactaataccagaacctgagaagcagcgcacgccccaggataaccagctcgcctacgtggtcatcggcatcttaaccctggccgcgatcgtggcggccaatgaaatgggccttctggaaaccacgaaacgagaccttggcatgagcaaggagccgggagttgtctccccaacttcgtacctcgacgtcgatctacatcccgcgtccgcttggaccctgtatgcagtggccaccacggtcattacccccatgctccgccacactatcgagaacagcaccgccaacgtatccctggcagccatcgcgaatcaggccgtcgtgctgatggggctcgacaaaggctggcccatcagcaaaatggaccttggggtaccgttattggccttgggctgttactcacaagtgaacccgctgacgctcaccgccgcggtcttgctgctggtgacgcactacgcgattatcgggcccggcttgcaggccaaagccacgcgcgaggcccagaaacgtacggccgcggggatcatgaaaaaccctaccgttgacgggatcatgaccatcgacctggacccggtgatttacgacagtaaattcgagaagcagctcggccaggtgatgctattagtgctctgcgccgtgcagctgctcctcatgcggacctcctgggccttctgcgaagccctcacgctggccaccgggcccatcaccaccctatgggagggcagccccggcaagttttggaacactaccatcgccgtgtctatggccaacatctttcgagggagctatcttgccggcgccgggctggcgttttcgatcatgaagtccgtcggaaccggtaagcgcgggaccggctcacagggggagactctcggcgagaagtggaaaaagaagttgaatcagctgagcaggaaggagttcgacctttacaagaagtccggcattacagaggtagatcggaccgaggccaaggagggactgaagagaggggaaatcacacatcacgccgtgtcccggggcagtgccaaattacagtggttcgtcgaacgcaatatggtaatcccggagggccgtgtgatagacttgggttgtgggcgcggagggtggtcgtactactgcgccggcctgaaaaaggtaacggaggtccggggctatacgaagggcggtccgggtcacgaggaacccgtccccatgagcacctatggatggaacatagtgaagctgatgtccggcaaggacgtattctacctgccacccgagaagtgtgacaccctgctgtgtgacatcggggagagctccccctcgcccaccgtggaggagtcccgcacgatccgagtgctgaagatggtcgagccctggctcaaaaataaccagttttgcataaaggtgctgaatccctatatgccaaccgtgattgagcatctagagcgcctccagcgaaaacacggcggcatgctggtccggaaccccttaagccggaactccacgcatgagatgtactggatctcaaacgggaccggcaacatcgtttccagcgtgaacatggtctctaggttacttctgaaccgatttacgatgacccatcgccgccctacgattgagaaagatgtggacctcggggcaggcacccggcacgtcaacgccgagccggagacgccgaacatggacataataggcgaacgcatcagaagaatcaaggaggagcacagttccacctggcactacgacgacgagaacccttacaagacctgggcttaccatggaagctacgaggtcaaagcgaccggatccgccagcagcatgatcaacggggtggtcaagctgttgacgaagccgtgggatgtggtgcccatggtcacccagatggccatgaccgacaccacaccgtttggccagcagcgggttttcaaagagaaggttgatacgaggacgccccggccgatgccaggaacccgcaaagtcatggagatcacagccgagtggttatggcggaccttgggccgcaacaagaggcctcgcctatgtacccgtgaggagtttatgaagaaagtgaggaccaacgccgcgatgggcgcggtgttcacggaggagaatcagtgggactcggcgcgcgccgcagttgaggatgaggagttctggaagctcgtggatcgggaacgcgaactgcacaagctggggaagtgtggcagctgcgtctacaacatgatggggaaaagagagaagaaacttggcgagttcgggaaagctaagggctccagagcgatctggtacatgtggctgggcgcgcggtacctcgagttcgaagccctggggtttcttaacgaggaccactggttcagccgcgagaacagttactcgggcgtcgagggggagggcctgcacaagctcgggtacatcctgcgggacatctccaagatccccggcggggccatgtatgccgatgacacggcggggtgggacacccgcattaccgaggacgacctgcataatgaggagaagatcacgcaacaaatggaccctgagcacagacaactcgctaacgctatcttcaaactgacgtaccaaaacaaggtggtgaaagtccagcgccctaccccaaagggcacggtgatggatattatcagcagaaaggatcaacgcgggtccggccaggtgggcacttatgggctgaacaccttcaccaacatggaagcccagctcatccggcagatggagggcgagggggtcctgagcaaggccgaccttgagaacccgcacttactggagaagaaagtgacgcagtggctggaaacaaagggcgttgaaaggttgaagcgtatggcaatctccggagacgactgcgtcgtcaagcccatagacgaccgcttcgccaatgccttactggccctcaatgacatggggaaggttcggaaggatattccccagtggcagccgagtaagggctggcacgactggcaacaggtgcccttctgctcccaccacttccacgagctgataatgaaagacggcaggaaattggtggtgccatgccggcctcaggatgagttaatcggccgagcacggatcagccagggggcggggtggtccctgagagagacggcctgcctgggcaaggcctacgcgcagatgtgggcgctcatgtacttccatcgccgggatctgagactcgccagcaacgccatctgctccgccgtcccggtgcactgggtgccaacctcgcgaacaacttggtctatccatgcacatcaccagtggatgacgaccgaggacatgctcactgtctggaatcgcgtctggatcgaagacaacccgtggatggaggataagacccccgtgagtacatgggaggacgtgccctatttaggtaagagagaggaccagtggtgcggcagtctcatcggactcacttcacgcgccacctgggcgcaaaacatcttgaccgcgatccagcaggtccggtcactgatcggcaacgaggaatttttggattacatgccctccatgaaaaggtttcggaaggaggaagagagcgaaggcgcgatctggtaa

SEQ ID NO: 26213 - RNA, 9873 nt, synthetic construct
  misc_feature 1..9873: note = derived and/or modified CDS sequence (opt11) from DENV-3__AY744680__SS-prME
  source 1..9873: mol_type = other RNA
acctcgctgtgcctcatgatgatgctgcctgccacgctggccttccatttgactagccgagacggcgaacccagaatgattgtggggaagaacgagcggggcaagagcttgctgttcaagaccgcgtctggcataaacatgtgtactctcatcgccatggacttaggtgagatgtgcgacgacaccgtgacctacaagtgcccactgatcaccgaagtggagcccgaggacatagactgctggtgcaatctaaccagcacctgggtaacctacggcacctgtaaccaggccggggagcatcggcgcgataagcggtcggttgccctggcgccacatgtcggcatggggttggacactcgcactcagacttggatgagcgcggagggggcttggcgccaggtcgaaaaggttgagacctgggccttccgacaccctgggttcaccatcctagcactgtttttggcgcattacatcggtacctccttgacccagaaggtggttatcttcattctgctcatgctcgtcaccccctccatgaccatgcggtgcgtcggggtgggcaaccgtgacttcgtagaaggcctgtccggagccacctgggtggatgtggtactggagcacggagggtgtgtgactaccatggccaaaaataaacccaccctcgacatcgaacttcaaaagacggaggccactcagctcgccacgctccggaagctgtgtatcgaggggaaaatcaccaatgtcaccacggactcacgctgccccacccaaggagaggcgatcttacccgaagaacaggatcagaactatgtctgcaagcacacctacgtggaccggggatggggcaacgggtgcggcctcttcgggaagggttccttagtgacctgcgccaagttccagtgcctggaaagcatcgagggaaaggcggtccagcacgagaaccttaagtatacggtgatcatcaccgtgcacaccggggaccagcaccaggtcggcaacgagacccagggggtgacggccgaaatcacgccccaggcctccaccgtcgaggcaattttgcccgagtatggcacgctgggcctcgagtgcagcccacgcaccggcctggacttcaatgaaatgattctgttaacgatgaagaacaaggcctggatggtgcaccggcagtggttcttcgacctgcccctgccatggacgtccggcgccaccaccgagactcctacctggaacaagaaggaattgctggtgacattcaagaacgcgcatgccaagaaacaggaggttgtggttttgggttcccaggagggcgcgatgcacaccgccctcacgggggccaccgagatccagacgtctggcgggacaagcattttcgcgggccacttaaagtgccgcctgaaaatggacaagctcgaattgaagggcatgtcctacgccatgtgcctgaacgcgttcgtcctaaagaaggaggttagcgagacgcagcacgggaccatcctgatcaaagtggagtacaagggcgaggacgctccatgcaagataccgttcagcacagaagacggccagggcaaggcccacaacggccgtctgatcacggccaaccccattgttactaagaaagaggaaccagtgaatatcgaggcggagccacccttcggggagtcaaacatcgtgatcggtatcggggacaaggctctgaaaatcaactggtacaagaaggggagctctatcgggaagatgttcgaagcgaccgctcgcggcgcccggcgcatggcgatcctcggcgacaccgcctgggacttcggtagcgtcgggggcgttctaaactcactcgggaagatggttcaccagatcttcggaagcgcctatacagctctcttctccggggtcagctggatcatgaagataggcataggggtgttactgacgtggatcggtctcaactccaagaacaccagcatgtccttctcttgcatcgttatcgggatcatcaccctgtatctgggagccgtagtgcaggcggacatggggtgtgtcatcaattggaagggcaaggagttgaagtgtggctccgggatcttcgtcactaatgaggtgcacacgtggaccgaacagtacaagttccaagccgacagccccaagcggctggccaccgctattgccggcgcgtgggagaacggggtgtgcgggatccgctccacgacgcgtatggagaacctgttgtggaagcagattgccaacgagctgaactacatcctgtgggagaacaacatcaagctaaccatcgtcgtgggggacgtgatcggcgtactggagcaggggaagaggaccctgacgccccaacccatggagctcaagtactcttggaagacgtggggaaaggcgaaaatcgtgacagcagagacccaaaattcaagtttcataatcgacggcccaaacacccctgagtgcccttcagcgtcaagagcctggaacgtgtgggaagtagaggactatgggtttggcgtgttcacgaccaacatctggctgaaacttcgtgagatgtacacccaactctgtgatcaccgcctgatgtccgccgccgtgaaagacgagcgggccgtccacgcggatatgggctactggatagagtcccagaagaatgggagctggaaacttgagaaggcctctctcatcgaggtgaaaacctgtacctggccaaagagccacacactgtggtccaacggcgttttagagagcgatatgataataccaaagtccttggccgggccgatctctcagcacaactatcgccccggctatcacacccagaccgccgggccgtggcatctgggcaagctggagttggacttcaactactgcgagggaaccacggtggtgatcaccgagaactgcgggacccggggcccctcgctccgcaccacgacggtgagcgggaagttaatccatgaatggtgctgccggtcctgcaccctgcctcccctacgttacatgggcgaggacgggtgctggtacggcatggagatccggcctatcaacgagaaagaagagaacatggtcaagagcctggtgtcggccggcagcgggaaggcggacaacttcaccatgggcgtgctctgtctggcaatcctgttcgaggaggtcatgagaggtaaattcggcaaaaagcatatgatcgcaggggccctattcacgttcgtcctcctgctctccgggcaaatcacctggcgggatatggcccacacgctgatcatgatcggtagcaacgcttccgaccgcatggggatgggggtgacttacctcgcactcatcgccaccttcaaaatccagcccttcctggccctcggattcttcctacggaaactgacctcacgcgagaaccttctccttggcgtcggcctggcgatggctaccaccctccagttaccggaggacatagaacagatggccaacgggatcgcactgggcctaatggctttgaagctgattacgcagttcgaaacctaccagctctggaccgcgttagtgagtctaatgtgttccaacaccatatttacgctcacagtggcctggaggacggccacattaatcctagctgtaatcagcctacttcccgtctgccaatcctcaagtatgcgcaagactgactggctgccgatgacggtggcagcgatgggggttccgcccttacccctgttcattttctctcttaaggacaccctaaagcggcgctcctggcctctgaacgagggcgtgatggcagtcgggctggtgtctattctcgcctccagctttctgcgcaacgacgtgcccatggcgggccccctcgtcgccggcgggttactcatcgcgtgttacgtgataaccggcacgtccgcggacctgaccgttgagaaggccgccgacgtcacctgggaggaagaggccgagcaaactggggtgagccacaacctcatgatcacggtcgacgacgacggcaccatgagaattaaggacgacgagacggaaaatatccttaccgtcctgctcaaaaccgctttgctgatagtatccgggatatttccctacagcataccggcgacgcttctcgtgtggcacacgtggcagaagcagacccaacgatcaggcgtgctgtgggacgtgccctccccgcccgagacccaaaaggccgaactcgaggagggcgtgtaccggatcaagcagcaggggatatttggcaagacacaggtgggggtgggtgtgcaaaaggaaggggtcttccataccatgtggcacgtgacccgcggcgcagtgctgacccacaacggcaaacggctggaaccgaactgggcaaatgtaaagaaagatcttatctcatatggcggagggtggaaattaagcgcacagtggcagaagggcgaggaagttcaagtgatcgccgtcgagcccggtaaaaaccccaagaacttccagaccatgccaggcatcttccagaccaccaccggcgaaattggggccatcgccctggacttcaagccggggacgagtgggtcccccatcatcaacagagagggcaaggttgtgggactgtatgggaacggcgtcgtaacgaaaaacggaggatatgtgagcgggatcgcgcaaactaatgccgagcccgatggcccgacccccgagctcgaggaggagatgtttaagaagcgtaacctgacgatcatggacctccaccccggctccggaaagacgcgcaaataccttccagcaattgtccgggaagccatcaagcgccgtcttcgcacactgatcctcgccccaacgcgggtggtggctgccgagatggaggaggccctgaagggtctgccaatcagatatcagacgacagccaccaagagcgagcacaccgggagggaaatcgtcgatctcatgtgccacgccacgttcaccatgcgcctgctctccccagtgcgagtccccaactacaacctcatcgtcatggacgaggcccacttcacagacccggccagcatcgccgcacgcggctatatctctacccgggtgggtatgggagaagcggccgccatcttcatgactgccacgccgcccggcactgctgacgcgttcccgcagagcaacgctcccatccaggacgaggagcgcgacatccccgaacggtcttggaactcgggtaacgagtggatcaccgattttgcaggcaagacggtgtggtttgtgccctccatcaaggccggaaacgacattgcaaattgcctacgcaagaacggaaagaaggtcatacagctgagccgtaagacttttgacacggagtaccagaagacaaaacttaatgattgggacttcgttgtcacgactgacataagtgagatgggtgcgaacttcaaggccgaccgggtgatcgatcctcgccggtgcctgaagccggtgatcttgaccgacggccccgagcgagttatactcgccggccccatgcccgttaccgtcgccagcgccgcgcagcgtcgcgggcgggtgggccgcaatcctcagaaggagaatgaccagtacatcttcacggggcagcccctgaacaacgacgaggaccacgcgcactggaccgaggccaagatgctgctagacaacatcaacaccccggagggcatcatcccagccctgttcgagcccgagcgcgagaaatccgcggccatcgatggtgagtaccgcctgaagggcgagagtcggaagacttttgttgagctcatgcgcagaggagatctgcccgtgtggctggcccacaaggtagcctccgaggggatcaagtacaccgatcggaagtggtgcttcgacggagaacggaacaaccaaatccttgaggaaaacatggacgtggagatctggacgaaggagggggagaagaagaagctacgccccaggtggctggacgcccgaacgtatagcgaccctttagcgctgaaggagttcaaagacttcgcggccggacggaagtccatagcactggatctggtaacagaaatcgggcgcgtgccaagccacctcgcccaccggacccggaacgccttagacaacctcgtgatgttgcacacgtcggagcatgggggccgcgcctaccgacatgccgtggaggagctgcccgagaccatggagaccctcctgctactaggtctgatgatactgctcacgggcggggcaatgctgtttctgatctccggcaagggcatcgggaagacgagcatcggcctcatctgcgtcgtggcgtctagcggtatgctatggatggctgacgtccccctgcaatggatcgcctctgccatcgtgctcgagttcttcatgatggtgctgctcattcctgagcccgaaaagcaacgcacgccccaggacaaccagctcgcctacgttgtgataggcatcctgaccctcgccgcgattgtcgccgccaacgagatggggttgctggagacaacgaagcgtgacctgggcatgagtaaggaaccgggcgtagtgtccccgacaagttatctcgacgtggacctccatcccgcctccgcgtggaccctatacgccgtggcgactaccgtgatcacccctatgctcaggcataccatagagaacagcaccgccaacgtctccctggccgcgatcgccaaccaagccgtggtgctcatgggactcgacaagggatggcccatcagcaagatggaccttggtgtgccgttgttggcgttagggtgctactcacaggttaacccactgacgctcactgccgctgtcctactgctagtgacccattacgccatcatcggccccggcctgcaggcaaaggccacacgcgaggcccaaaaacgcacggcggccggcatcatgaagaaccccacggtcgacgggatcatgactatcgacctagacccggtgatatacgactctaagttcgagaagcagcttggtcaggtgatgttactggtcctctgcgcggtgcagctactcctcatgcggacctcctgggctttctgtgaagcgctgacgctggccactggacccatcacaaccctctgggagggcagccccggcaagttttggaacacgaccatcgccgtgtccatggcgaacatcttccgagggtcgtatctggccggcgcgggactggccttctcgattatgaaaagcgtgggcactggtaagcggggcaccggctcccagggggagacgctcggtgagaagtggaaaaagaagctgaatcagctgtctcggaaggagttcgatttatacaagaagtccgggatcaccgaggtggatcgcacggaggctaaagagggcctaaaacgcggagagatcacccatcacgccgtgtcccgaggaagtgcaaaattacagtggtttgtcgagcgcaatatggtgatccctgagggacgggtaattgacctggggtgcggccgcggtgggtggtcctactattgtgcggggttaaagaaggtcaccgaggttcggggctacaccaagggaggtccgggccacgaggaacccgtgccgatgtccacatacggctggaacatagtcaagctgatgagtggcaaggacgtcttctacttaccgccagaaaagtgcgacaccctgctctgcgacatcggggagagctcccccagccccaccgtggaggagtcccgcaccatccgagtcctgaagatggtagagccgtggctcaagaataaccagttctgcattaaggtgctgaatccctacatgcccaccgtcatcgagcatttggagcgcctccaacgcaagcacgggggcatgcttgtacggaatcccctgagccgtaattccacccacgaaatgtactggatcagcaacgggaccgggaacatcgtctccagcgtcaacatggtgtcccggttactgctgaaccggttcacgatgacccaccggcgccccaccatcgagaaggatgtggacctcggtgcaggtacgcgacacgtgaacgccgaaccggagacccccaatatggacgtcatcggcgagcgcatccggcgtataaaggaggagcactcttccacctggcattacgacgacgaaaacccctacaagacctgggcctatcacgggtcctacgaagtcaaagctaccggctccgccagctctatgatcaatggggtggtgaaacttttaacgaagccgtgggacgtcgtgcccatggtcacccaaatggcaatgaccgacaccactccctttggtcagcagcgtgtgttcaaggagaaggtggacactcgtacgccccggccgatgcccgggacccggaaggtgatggagatcacggccgagtggctctggagaaccctgggtcgcaacaagaggcctcgcctttgcaccagagaggagttcatcaaaaaggtccgcactaacgctgccatgggcgccgtgttcacagaggagaaccagtgggacagcgcccgcgccgccgtggaagacgaggagttctggaagctcgtagaccgggaacgcgagttacacaaactcgggaagtgcggctcgtgcgtgtacaacatgatggggaagcgggagaagaagctcggcgagttcggcaaggcgaagggctccagagccatctggtacatgtggctgggcgcccggtacctggagttcgaagcccttgggttcctgaacgaggaccactggttttcaagggagaactcatacagcggcgtagagggggagggcctgcataagctagggtacatcctgcgtgacatctccaagattcccggcggcgctatgtacgcggatgacacagcagggtgggacacgcgcatcacagaggacgacctccataatgaggagaagatcacccagcaaatggaccccgagcaccggcagctcgccaacgccatcttcaagctgacctatcagaacaaggtagttaaggtgcaaagacctaccccaaagggaacggtgatggacatcatcagccggaaagatcagagagggagtggtcaggtgggcacatatgggctaaacacctttactaatatggaggcccagctcatccgacagatggaaggagagggggttctgagcaaagccgacctcgagaatccccacctcctggagaagaaggtcacccaatggctggaaaccaagggtgtggagcgcctcaagaggatggcgatctccggagacgactgtgtggtcaagccaatcgatgaccgcttcgccaacgccctcctggccctcaacgacatgggcaaagtccgtaaggacatccctcaatggcagcctagcaaaggctggcacgactggcagcaagtccccttttgttcccaccacttccatgaactgattatgaaggatggtcgcaaactggtcgtgccctgcaggccccaggacgagctcatagggcgcgcgcggattagccagggcgccggatggtctcttcgcgagaccgcctgcttagggaaggcctacgcacaaatgtgggccctcatgtacttccatcgcagagatctaaggctggccagtaacgccatctgctcggctgtgcccgtacactgggtgcctaccagccggaccacttggtccatccacgcgcaccaccaatggatgactacagaggatatgctcactgtgtggaaccgcgtctggatcgaagacaacccttggatggaggacaagacccccgtcaccacgtgggaggacgtgccgtacctgggcaagcgggaggaccagtggtgcgggtccctgatagggctcacatcccgcgccacctgggcccagaatatcctgacggccatccagcaggtacggagcctgattggcaacgaagagttcttagactacatgccgtccatgaagcgcttccggaaggaggaggagagtgaaggcgccatatggtag

SEQ ID NO: 26214 - RNA, 9873 nt, synthetic construct
  misc_feature 1..9873: note = derived and/or modified CDS sequence (opt11) from DENV-3__AY744681__SS-prME
  source 1..9873: mol_type = other RNA
acttcgctctgcctcatgatgatgctgcccgccaccctggccttccaccttacctcccgcgacggggaaccccgcatgatcgtggggaaaaacgaaaggggtaagagcttactgttcaaaaccgcctccgggatcaatatgtgtaccctcatcgccatggacttaggcgagatgtgcgacgacaccgtgacttataaatgtcccttaatcaccgaagtggagcctgaagacattgactgctggtgtaacctcacctcaacatgggtgacttacgggacttgcaatcaggccggcgagcaccggagagacaagagatccgtggcactggcgccccacgtaggtatggggttggacacccgcacccagacatggatgagcgccgagggggcgtggcggcaagtcgagaaggtcgagacctgggccttccgtcacccggggttcaccatcctcgcactgtttctggcgcactacatcggaacctcactcacgcagaaggtggtgatctttattctgctgatgttggtgacccccagcatgaccatgcgctgcgtgggggtgggcaacagggacttcgtcgaaggcctgtccggagcaacctgggtggacgtagtcctagagcacggagggtgtgtcacgaccatggccaagaacaagccaaccctcgacatcgaactccaaaagaccgaggccacgcagctcgccaccctccgcaagttatgcatcgagggcaggatcacaaatgttacgacggacagccggtgtcccacacagggcgaagcaatcctgccggaagaacaggatcaaaactacgtttgcaagcatacttatgtggatcgcggatggggaaacggctgcggcctcttcggtaaaggctcattagtgacttgcgcaaagtttcaatgcctggagagcatagagggcaaggccgtacagcacgagaatctaaagtataccgtgatcattacggtgcacactggcgaccagcaccaggtcggctcggagacacagggggtgaccgccgagatcacgccccaggccagcaccgtggaggcgatcctgcccgagtacggtaccctaggcctagaatgcagtccccggaccggtctggattttaatgagatgatattacttacgatgaagaacaaggcctggatggtgcaccgccagtggttcttcgaccttccgctgccctggacgtctggcgccaccacggaaacgcctacctggaacaagaaggaactattagtgaccttcaaaaacgcgcacgccaagaagcaggaagtcgtggtcctagggtcgcaggagggagcgatgcacaccgccctcacgggggctaccgaaatacagacttcaggtggaaccagcatcttcgccggccacctgaagtgtcggctgaagatggataagctcgagctgaagggcatgagctacgctatgtgtctgaacgcgttcgtccttaaaaaggaggtgagcgagacgcagcacgggacaatcctgatcaaggtggagtataagggcgaggacgccccctgcaagataccgttctccaccgaggacggccaaggcaaggctcacaacgggagactgatcaccgctaaccccatcgtgacgaaaaaggaagaacccgtgaacatcgaggccgagcccccgttcggtgaatccaatatcgtgatcggcatcggtgataaagccctgaaaatcaactggtacaaaaagggctcgagtatcggtaagatgttcgaagccaccgcccggggcgcccgccggatggcgattcttggcgataccgcctgggacttcgggtccgtcggaggggttctaaacagcctgggcaagatggtgcaccaaattttcgggtccgcatacaccgcccttttcagcggagtttcctggatcatgaaaatcggaatcggggtgctccttacgtggatcgggctcaacagcaagaacaccagtatgagcttctcctgtattgtaatcgggatcatcacgttgtacctgggcgccgtcgtgcaggcggacatgggttgcgtaatcaactggaagggtaaagagctgaaatgcggcagcggtatcttcgtcaccaatgaagtgcacacgtggaccgagcaatataagttccaggccgattcacccaagcgcttagccacggccatcgccggcgcgtgggagaacggggtttgcggcatcagaagcacaactcgcatggagaacctgctttggaagcagatcgccaacgagcttaactacatcctgtgggaaaacaacatcaagctcaccattgtcgtgggtgacgtgattggcgtccttgagcaaggcaagcggacactgacaccgcagcccatggagctcaaatattcctggaagacctgggggaaagccaagatagtgactgcggagactcagaacagctccttcatcatcgacggtcccaatacccccgaatgccccagcgcgagcagagcctggaatgtgtgggaggtggaggattacgggtttggcgttttcacgacgaacatctggctgaagctgcgcgagatgtacacacagctctgtgatcaccggttgatgtctgctgccgtgaaggacgaacgcgccgtccacgcggacatgggctactggatagagagccagaaaaacgggtcctggaagctggagaaggcgagcttgatcgaggtgaagacctgcacctggcccaagtcccatacgctgtggagcaacggtgtcctggagtccgacatgatcataccgaagtctcttgccggtcccatctcacaacacaactatcgacctggctaccacacacagaccgccgggccgtggcacctcggcaagctggaactggacttcaactactgtgagggcactaccgtcgtgatcaccgagaattgcggaacccgcgggccgagcctgaggacaacgaccgtgtccgggaagctcatccacgagtggtgctgccgcagctgcacccttcctcccttacggtacatgggcgaagacgggtgctggtatggcatggagatacgcccaatcaacgagaaggaggagaacatggtcaagtccctggtgagcgccggctccgggaaagctgacaactttactatgggcgtgctctgcctggcgatcctgttcgaggaggtaatgcggggcaaatttggcaaaaagcacatgatcgccggcgccctctttacattcgtcctgctactcagcggccagatcacttggcgcgacatggcgcacaccctaatcatgatcggctccaacgcgtcggaccggatgggtatgggcgtgacatacctggccctcattgccacgttcaaaatccaacctttcctggcactggggttctttcttcgcaagctgactagccgggagaacttattactgggcgtgggattggctatggccaccacactccagctgcccgaggacatcgaacagatggcaaacggtatcgctctgggcctcatggccctgaagttgataacacagttcgaaacctatcagctctggacggcgctggtatccttaatgtgcagcaacaccatcttcacgctcaccgtggcatggcgcaccgccaccctgatcctggccgtcatctcccttctgcccgtatgccagagctcatccatgcggaagacggactggcttcccatgacagtggccgccatgggagttcccccgctcccactcttcatcttctctttaaaggacacgctcaagcggcgcagctggcccctgaacgagggcgtgatggcggtcgggctggtgtccatcctggccagctcctttctgcggaacgatgtccccatggcgggtcccttagtagctggcgggctcctgatcgcttgctacgtcatcaccggcacgagcgccgacttgaccgttgagaaggccgccgatgtcacttgggaggaggaggccgagcaaaccggggtatcccacaacttgatgataacggtggatgacgatggcacgatgcgcatcaaggacgacgagaccgaaaacatcctcactgtcctgctaaagaccgcgttactaatcgtatcagggatcttcccctactccatacctgccacgctcctggtgtggcatacatggcagaaacagacgcaacggagcggggtcctgtgggatgtaccgagcccgcccgagacccagaaggcggagctcgaggagggcgtgtaccgcatcaaacagcaggggatcttcggcaagacgcaggtcggggttggcgtgcagaaagagggggtcttccacaccatgtggcacgtaacccggggcgccgtgctgacccacaacggtaagcgcctggagccgaactgggcgaacgtcaagaaggatttgatctcatacggaggcgggtggaagctgtccgcccagtggcaaaagggagaggaggtccaggtgatcgccgtcgagcccgggaaaaatcctaagaacttccagacgatgcctggcatctttcagaccaccactggcgagatcggcgcgatagcactggatttcaaaccgggaacgagcggtagccccatcatcaaccgggagggcaaggtggtaggtttatatggcaacggcgtcgtgaccaagaacgggggctacgtgtcggggatagcccagaccaacgcggagcccgacggcccgacccccgagctggaggaagaaatgttcaagaaacggaacttaacaatcatggacctgcaccccggcagtggcaagactcggaaatacctccccgcgatcgttcgcgaggccatcaagcgacgcctgcggaccctgatcttagcgccaacccgcgtggtggcggctgagatggaggaggccctgaagggcttgcctatcagataccagactaccgccaccaagtccgagcacaccggtcgcgagattgtcgacctcatgtgccacgccactttcaccatgcggcttctgagccccgtgcgagtgcccaactacaacctcatcgttatggacgaggctcacttcaccgacccggcctccatagccgcacggggctacatatcgacgcgcgtggggatgggcgaggcggctgccatcttcatgacggcaacgccacccggcaccgccgacgcgtttccacagtccaatgccccgatccaggacgaggagcgggacatcccggagcgcagctggaactccgggaacgagtggatcaccgacttcgccggcaagacggtgtggttcgtgcccagcatcaaggccgggaacgacatcgccaattgccttcgcaagaacggaaagaaggtcatacagttgtcccggaagaccttcgacaccgagtaccagaagaccaagctcaacgactgggatttcgtggttacgacagacatcagcgagatgggggctaatttcaaagcggaccgagtgatcgacccacggcgctgcctgaaacctgttatcctaacggatgggcccgaaagggtcattttagccggccccatgcccgtgaccgtggcctccgcggcgcagcgccgcgggagagtaggtcggaacccgcaaaaggagaacgaccaatacatcttcaccgggcaacctctaaacaacgacgaggaccacgcgcactggacggaggcaaagatgctgctcgacaacataaacactcccgaggggatcatccccgccctgttcgaaccggagcgcgagaagtccgcggccatcgatggtgagtaccgtctgaagggcgaaagccgcaagaccttcgtcgagcttatgcggaggggcgacctccctgtgtggctggcccataaggtcgcctcagaggggattaagtacaccgatcggaagtggtgcttcgatggcgagcgcaacaaccagatcctcgaggagaacatggacgtcgaaatctggacgaaggaaggtgagaagaagaaactacggccccgctggctggatgcccggacttactcggatcccttggcgctgaaggaatttaaagatttcgccgctggccgaaagagtatcgccttggatctcgtcactgagataggccgcgtgccgtcccacctggcccaccggacacggaacgctctggacaacctcgtgatgctgcacacgagtgagcacgggggccgggcctatcgccacgcggtcgaggagctgcccgagaccatggagaccctcctgctcctcgggctgatgatccttctcaccgggggagcaatgcttttcctgatcagcgggaagggtatcggcaagacgtccataggcctcatctgtgtggtggcaagctccgggatgctgtggatggcggacgtccctctccagtggatagccagcgccatcgtgctcgagttctttatgatggtgctgctgatcccggagcccgagaagcaacggacgccgcaggataaccagctcgcctatgtcgttatcggcatcctgactctggctgcgatcgtggccgcaaacgagatggggctcctggagaccacgaaacgggacctcggcatgtccaaggagcctggcgtcgttagcccgacttcctacctcgacgttgacttgcatccagccagcgcgtggaccctctacgccgttgcaaccacggtcatcactccgatgctccgacataccatagagaactccaccgctaacgtgagtcttgccgccatcgccaaccaggcggtcgttctgatgggactagacaagggctggcccatctccaaaatggatctgggggttccgctgctagccctgggctgttactctcaggtcaaccccctgacgctcaccgctgcggtgttgttattggttacccactacgccatcataggcccgggcttacaggccaaggcgacccgcgaagcccagaagcggaccgcggcaggcataatgaaaaaccccaccgtcgatggaattatgaccatcgacctagaccccgtgatctacgactccaagttcgagaaacaactcggccaggtaatgctgctggtcttgtgtgccgtgcagcttttactcatgcgcaccagctgggccttctgcgaggccctgacccttgccaccgggccgatcactactctttgggaaggctcccccggcaagttttggaacacgaccatcgctgttagcatggcaaatatattccgggggagttacctggcgggagcggggctggccttcagcatcatgaagtccgtaggcaccggaaaacgcggcaccggttctcagggtgagactctcggagagaagtggaagaagaagctgaaccagctgagccggaaggagttcgacctatacaagaaatccggcatcaccgaagttgatcggaccgaggcgaaggaggggctgaaacgtggggagatcacccatcacgccgtgagccgcggctccgccaagttacagtggttcgtcgagagaaacatggtgatccctgagggccgagtgattgacctcgggtgtggccgcggcggatggagctattactgcgcggggctgaagaaagtcaccgaggtgcggggctacacgaaaggtgggccgggccacgaggagccggtgcctatgtccacatacggctggaacatcgtgaagctgatgagcgggaaagacgttttctaccttccgccggagaagtgcgatacgctcttatgcgacataggggagtccagcccctccccaaccgttgaggaaagccgcacgatcagagtgctgaaaatggtggagccctggctaaagaataaccaattttgcatcaaggtgttgaacccctacatgcccaccgtcatcgaacacctggagcgcctccagaggaagcacggcggtatgctggtgcgtaaccctctgtcccggaacagcactcacgagatgtactggatctccaacgggaccggcaatatcgtgagctccgtgaacatggtgagccgtctcctgctgaaccggtttactatgacccatcgccggcccaccatagagaaggacgtggatctgggggccggcacccgccacgtgaacgccgagccggagacgcctaacatggatgtgatcggcgaacgcatcaggcggatcaaggaggaacactcatccacatggcactacgacgacgagaacccctacaaaacgtgggcctaccatgggagctatgaggtaaaggccaccggcagcgcaagctccatgatcaacggtgttgttaagctgctaacgaagccatgggacgtcgtgcccatggtgacccagatggccatgaccgacacgacgccctttggccagcaacgcgttttcaaagagaaggttgacacccgcacgcccaggccgatgccggggacccggaaggtgatggagatcactgccgagtggttgtggcgcaccttgggccgcaacaagcgccctcggctctgcacgcgcgaggagttcatcaagaaggtccgcactaacgcagcaatgggggcagtctttacagaggaaaaccagtgggacagcgcccgggcggccgttgaggacgaggaattttggaagctggtggatcgcgagcgcgagctgcacaaactagggaagtgcggctcctgtgtctacaacatgatgggaaagcgcgagaagaagctaggcgagttcgggaaggcgaagggctcgcgggccatctggtacatgtggctgggcgccagatacctggagttcgaggccctcggattcctgaatgaggatcattggttctcccgggagaacagctattccggtgttgagggtgagggcctgcacaagctcgggtacattttacgcgacatcagcaagatccccggcggcgcgatgtacgccgacgacaccgcggggtgggacacccggatcactgaggatgacctgcacaacgaggagaagataacacaacagatggacccggaacaccgccgcctcgccaacgccatcttcaagttaacctaccagaacaaggtcgtgaaggtacagcgccccacccccaaggggacggtcatggatataatctctcgcaaagaccagcgcgggtcaggccaagtgggcacgtacgggcttaacacgttcaccaacatggaggcccagcttatccggcaaatggaaggcgagggggtcttatccaaggccgacctagagaacccccacctcctagagaagaaggtcacccagtggctagagaccaagggcgtagagcgcctcaaacggatggcgatcagcggcgacgactgcgtcgtcaaacctatcgacgacaggttcgcaaatgccttgctcgcattaaacgacatgggcaaggtgcgaaaagacatcccgcagtggcagccctctaagggctggcacgactggcagcaggtcccattctgcagccatcacttccacgagctgatcatgaaagacgggcgtaagctagttgtgccatgccgaccccaggacgaactcattggccgagcgcgcatttcccaaggcgctggatggagtctccgggagactgcatgcctgggcaaagcgtatgcgcagatgtgggccctcatgtatttccaccgacgggatctgcgactggccagcaacgcaatttgctctgcggtgccagttcactgggtacccacgagccggaccacttggagcatccacgcacaccatcaatggatgacgactgaggacatgctcaccgtgtggaatcgtgtctggatcgaggacaacccctggatggaggacaaaacgcccgtgacgacctgggaggacgtgccctacttaggcaaacgggaggaccagtggtgcggcagcctaatcgggctcacctcaagggccacgtgggcccagaacatcctaacggccatccagcaggtccggagcctgatcgggaacgaagagttcttggactatatgccctcgatgaagcgctttcgcaaggaggaagagagcgagggggccatctggtga

SEQ ID NO: 26215 - RNA, 9873 nt, synthetic construct
  misc_feature 1..9873: note = derived and/or modified CDS sequence (opt11) from DENV-3__AY744682__SS-prME
  source 1..9873: mol_type = other RNA
accagcctctgtcttatgatgatgctccctgccacgctggccttccatctcacatccagggacggcgagcctcggatgatcgtagggaagaacgagcgcggcaaatcgctactgttcaaaaccgcctccgggatcaatatgtgcacattgatcgccatggatctaggcgagatgtgcgacgacactgtgacatacaagtgtcccctgatcactgaagtagaaccagaggatatcgactgctggtgcaacctaaccagcacctgggtgacctacgggacctgcaaccaggccggcgaacaccgtagggacaagaggtcagtggccttggcgccccatgttggtatgggcctagacacgcgaacgcagacttggatgtctgctgaaggcgcctggcgccaggtggagaaagtcgagacctgggccttccgccaccccggctttaccatcctagccctgtttctcgcgcactacatcgggacctccctaacgcagaaggtggtgattttcatcctgctgatgctcgtaaccccctcaatgacgatgcgatgcgtcggagttggtaatcgcgacttcgtggagggcctgagtggggccacctgggtcgacgtagtactagagcacggggggtgcgtgacaaccatggccaaaaataagccgacccttgatatagaattacaaaaaacagaagcgacacagcttgccaccctgcgtaaactgtgtattgaagggaaaatcacgaacgttaccactgacagccgctgccccactcagggcgaagcgatcctgccggaggagcaggaccaaaattacgtttgcaagcacacatacgtggaccggggatggggcaacgggtgcggcctgttcggtaagggatccttagtaacctgcgcgaagttccagtgcctggagagcatcgaaggaaaagccgtccagcacgagaatctaaaatacacggtgacgatcacagtgcacaccggggaccagcaccaggtcgggaatgagacgcagggcgtgaccgcggagatcacgccccaggcctcaaccgtcgaggcgattttacccgagtacggcacattggggctcgagtgcagtccccgcacgggcttagattttaacgagatgatccttctcaccatgaagaataaggcgtggatggtgcatagacaatggttcttcgatctgccattaccctggacctccggggccacaacggaaactcccacctggaacaaaaaagagcttctggttacctttaagaacgcccacgccaagaagcaggaagtagtggtgctaggaagccaagaaggcgcgatgcatacggcgttaaccggagccaccgagatccagacctcagggggaacgtcaatcttcgcgggccatctgaaatgtcgcctaaagatggacaagctcgagctgaaaggtatgtcctatgctatgtgcctgaacgcattcgtcctaaagaaggaggtaagtgagacccagcatgggaccatcctaatcaaagtcgagtacaaaggcgaggacgctccctgcaagataccattctcaaccgaagacggacaaggcaaagcccacaatgggagactgatcacggccaacccgatcgtcaccaaaaaggaggagccggtgaacatagaggctgagccgccgttcggggagagcaatatcgtgattggaatcggggacaaggccctgaagatcaattggtacaagaagggcagttctatcggtaagatgttcgaagccaccgcgcgcggcgctcgtcgcatggcgatactcggcgataccgcctgggatttcgggagcgtgggaggagtgctgaactccttgggaaagatggtgcaccagatcttcgggagcgcctacacggccttgttctccggcgtaagctggattatgaagataggcataggggtgcttctcacctggatcggcctcaactctaagaacacaagcatgtccttcagctgtatcgtgatagggatcataaccctgtacctgggcgccgtagtgcaagcagatatgggctgtgtgatcaactggaaggggaaagagttaaagtgcggatcagggatcttcgtcactaacgaggtgcacacctggaccgagcaatacaaattccaggccgacagccccaagcgcctcgctaccgcgatagcgggggcgtgggagaacggggtgtgcggtatccgctccacgacgcgcatggagaacctgctatggaagcagatcgctaacgaactaaattacattctatgggaaaacaacatcaagctcaccatcgtagttggggacgtgatcggcgtcctggagcagggcaaacggaccctcacgccgcagcccatggagttaaagtatagctggaagacctgggggaaggccaagatcgtgacagccgagactcagaactccagctttatcattgatggcccgaatactcccgaatgcccgtcggcctcaagggcgtggaacgtttgggaggtcgaagactatggattcggcgtatttaccaccaatatttggttaaagttacgggaagtctacacccaactctgtgaccacagattaatgtctgccgctgttaaagacgagcgggcggtgcacgcggacatgggatactggatcgaaagtcaaaagaacgggagctggaagctcgagaaggcctccttgattgaagtgaaaacctgcacctggcccaagagtcacaccctgtggagtaatggtgtccttgagtcggacatgattatcccgaagtccttggctgggcctatctcccagcataattaccgccccggctatcacacccagaccgccgggccgtggcacctcggcaagctcgaactcgatttcaactactgtgagggcacgaccgtcgttataaccgagaactgcggtacaagggggccctccctgcgcacgacgaccgtcagcgggaaactgatccatgagtggtgctgccggtcgtgcaccttaccgcccttacgttacatgggcgaggatgggtgctggtacggcatggagataagaccaattaatgagaaggaggagaatatggtcaagagcctggttagtgcaggcagcggcaaggcggacaactttacgatgggcgtcctttgcctggcgatactgttcgaggaggtgatgcggggcaagttcgggaaaaagcatatgatcagcggggcactattcaccttcgtgctgcttcttagcggccagatcacgtggcgggacatggctcacacacttatcatgatcggctccaacgcctccgaccgtatggggatgggcgtcacgtaccttgcacttatcgcaaccttcaagatccagcctttcctggccctggggttctttttacgaaagctgacgtctcgggagaacctcctcctgggtgtagggctggccatggcgaccacgctccagctgcccgaggacatagagcaaatggccaatgggatcgcgctgggcctcatggccctcaagctgataacgcagttcgaaacgtatcagctctggaccgctctggtgtcccttatgtgtagcaacacgatctttacccttaccgtcgcctggaggacggccactctgatcctggccgtgatatccttactgcccgtgtgccagagctccagtatgagaaagacagactggctccccatgaccgtcgcggccatgggggtgccccctttgcccctttttatctttagcctgaaagacactctaaagcggcggagctggccactgaacgagggcgtcatggcggtagggctggtgagcatcctcgctagctccttcctccgaaacgatgttcccatggcggggccccttgtggctggagggttactgatagcctgctacgtcatcacgggcacgagcgcggatctgactgtggagaaggcagccgatgttacctgggaggaagaagcggagcaaacgggggtttcccacaatttgatgataaccgttgacgacgacggcacgatgcgtatcaaggacgacgaaaccgaaaacattttgaccgtgctgttaaagactgcgctgctgatcgtgagtgggatcttcccctactccattccggcaacgctcctggtgtggcatacctggcagaagcagacccaaagaagcggagtgctttgggacgtgccgagtccgcccgagacgcagaaagccgagctcgaggagggcgtctatcggatcaagcagcaggggatcttcgggaagactcaagtgggtgtcggtgtccagaaagagggagtgttccatacgatgtggcacgtgacccgcggcgccgtcctaacgcataacggtaagcgcctagagcctaactgggccaatgtgaagaaggacctcatcagttacgggggcggatggaagctgagcgcgcaatggcagaaaggtgaggaggtgcaggtgatagcagtcgaacccgggaagaaccccaagaactttcaaactatgcctggaatattccagaccaccacaggcgagatcggtgccatcgccctcgattttaagccgggtacaagcgggtccccaatcatcaaccgtgaggggaaggtggtcgggctgtacgggaatggcgtggtgacgaaaaacgggggctatgtctcaggtatcgcacagacaaacgcggagccggacggaccgactcctgaactcgaagaggagatgttcaaaaaacggaacttgaccatcatggatctgcatcccgggtctggaaagacccgcaagtacttgcccgccatcgtgcgggaggccatcaagcgtcggctacgaacactgatccttgctccgacgcgtgtggtcgccgctgagatggaagaggccctgaaggggctgcccattcgctaccaaaccaccgctaccaagagtgagcacacggggcgggaaatcgtggatctcatgtgccatgccaccttcaccatgaggctgctgagccccgttcgggtcccgaactacaacctaatcgtgatggacgaggcgcattttaccgacccagcgtccatcgccgccaggggctatatctccacgcgtgtagggatgggcgaagcggcagccattttcatgaccgctacaccgcccggcaccgccgacgcctttccgcaatctaacgcacctatccaggatgaggagcgcgacatccccgagcggagctggaactctgggaacgagtggatcacggacttcgccgggaagaccgtctggttcgtgccgagcatcaaggccgggaacgacatcgcgaattgtctgagaaagaacggcaagaaggtgattcagctctcccgcaaaacgttcgacactgagtaccagaagacgaaactcaacgactgggacttcgtcgtgaccacggatatcagcgaaatgggagccaacttcaaagcggatcgggtgattgatccccgacggtgtttgaaaccggtaatactcaccgacggacccgagcgcgtgatcctcgccggccccatgcccgtcacggtcgcctctgcggcacagcggcgcgggagggtgggtagaaacccgcagaaagagaacgaccagtacatcttcaccggtcagccgctaaataatgacgaggaccacgcacattggaccgaagcaaagatgctgctcgacaacatcaacacacccgaagggattatccctgccctgtttgagccggaacgggagaaaagcgcggcaattgacggagaatacagactgaaaggtgaaagccgtaagaccttcgttgaactcatgcgccgtggcgacctacctgtctggctggcccacaaggtcgcaagcgagggcatcaaatatactgaccgcaagtggtgcttcgacggcgagcggaataaccaaattttggaagagaacatggatgttgagatttggactaaggagggggaaaagaagaagctgcgccctcgatggctggatgccaggacctattccgatccgttggccctgaaggagttcaaggatttcgcagcgggccgcaagtcgatcgccctcgacctcgtgaccgagatcggccgcgtcccatcacatctggcccaccgcacgcggaacgccctggacaacctggtcatgctgcacacctcagagcacggtgggcgcgcctacagacatgcggtggaagaactgcccgagaccatggagaccctactgctgctcgggctgatgatcctgctcacgggaggggcaatgctcttcttaatttcgggcaagggaatcgggaagacgagtattggcttgatatgtgtggtcgctagctccggcatgctgtggatggcagacgtgcctctgcagtggattgcgagcgccatcgtgttggagttcttcatgatggtcctgctgatcccggagcccgaaaaacagcgcacgccgcaggacaaccagctcgcctacgtggtgatcggcatcctcaccttggctgctattgtcgcggccaacgagatgggccttttggaaacgacgaagcgggacctaggcatgtcgaaggagcccggcgtggtgagccctactagctacctcgacgtggacctgcatcccgcctcagcatggactctttacgctgtggccaccaccgtgataacccccatgttgcgtcatacgatcgaaaactccaccgcaaacgtgagcctggcagccattgcgaaccaggctgtagtccttatgggactagacaaaggctggcccatctcaaagatggacctgggcgtcccgctgttggcgctgggatgctattctcaggtgaatcccctgaccctcaccgcggccgtccttttactcgtcacccactacgcaatcatcgggcccggcttacaggcaaaggcgacacgagaagcccaaaagcgaacggccgcgggcattatgaaaaacccaaccgttgacgggatcatgacaatcgatctggatccagttatatacgactccaagttcgagaagcagctaggacaggtgatgctgctggtactctgcgccgtacagctgctgttaatgcgaacgagctgggccttctgtgaagcactgaccttggcgactgggcccatcacaactttgtgggagggctcccccggcaagttctggaacaccacgatcgcagtttcgatggccaacatcttccgcgggtcctacctcgccggcgccgggctggccttcagtatcatgaagtccgtgggaaccgggaaaagggggactgggagccagggggaaacgctcggcgaaaagtggaagaagaagttaaaccagctgtcgagaaaagaatttgacctctacaaaaagtccgggatcaccgaggtagaccggaccgaggccaaggagggtttgaagaggggggagattacccaccatgccgtctcgcggggctcagccaagttgcagtggttcgtggagagaaacatggtgatccccgagggccgggtcatcgacctagggtgtggccgcggggggtggagctactactgcgccggcctcaaaaaggttacggaggttcgggggtacaccaagggtggtcccgggcacgaagagcccgtccccatgtccacctacgggtggaacatcgtgaagttaatgtctggcaaggacgtgttctacctaccgcccgagaagtgcgatacactgctatgcgacatcggggagtccagcccttcccccacggtcgaggaatcacggaccattagagtgttaaagatggttgaaccctggcttaagaacaaccagttctgtataaaggtgttgaacccttacatgcccaccgtcatcgagcatctggaacgcctccagcgcaagcacggcggcatgctggtaaggaaccccctgtccaggaacagtactcatgaaatgtactggatttccaacgggacgggaaacatcgtcagctccgtgaatatggttagcaggcttctgctgaaccgcttcaccatgacccaccggcgccccacgattgagaaagatgttgatcttggggcgggtacccgacacgtgaatgccgagccggagacccccaacatggatgtcatcggcgagcgcatccggcgcataaaagaggagcacagtagcacctggcactacgacgatgagaacccctacaaaacatgggcctatcacggctcatacgaggtgaaggcaacaggttcagctagctctatgatcaatggggtggttaagctgcttacgaaaccttgggacgtggtgccgatggtcacccagatggctatgacagacacaacccccttcggccagcagagagtgttcaaggagaaggtggacacccgcacacctcggccgatgcccgggacgcgcaaggtcatggagatcaccgctgagtggttgtggcgcaccctgggccggaacaagcgaccccgtctgtgtactcgagaagagttcataaagaaggtccgcacgaacgctgccatgggagcggtgtttaccgaggagaaccagtgggacagtgcgcgcgcagccgtcgaggacgaggagttctggaagctcgtcgaccgggagcgtgagcttcacaagctagggaaatgcggttcctgtgtttacaacatgatgggtaaacgggagaagaagctcggcgaattcgggaaggcgaaaggtagtcgtgctatttggtacatgtggctgggcgcccggtacctggaattcgaagccctcgggttcttgaacgaagatcactggttcagtcgcgagaatagctattccggcgttgagggcgagggcctgcacaagctcgggtacatactgcgggatattagcaagattccaggcggcgccatgtatgcggacgacaccgctggatgggatactagaatcacggaggatgacctgcacaacgaagaaaagatcactcagcagatggacccagagcaccggcaactcgccaacgccattttcaagctcacataccaaaacaaagtggtgaaggttcagcgccccacccccaagggcacagtgatggatatcattagccgaaaggaccaacgcggcagcgggcaagttgggacatatggcttaaacaccttcaccaacatggaggcccagctcattcgtcagatggagggtgagggggtcctgtctaaggccgacctggaaaacccctaccttctggaaaagaaggtcacgcaatggctggagaccaagggcgtcgagaggctcaagcgaatggcgataagcggggacgactgtgtggtgaagccgatcgacgatcgcttcgccaacgctttgctagcgctcaacgacatgggcaaggtacggaaagacattccacagtggcagccaagtaagggctggcacgactggcagcaagtcccgttttgtagccatcatttccacgaacttatcatgaaggacgggaggaagctggtagtgccttgccggccccaggacgagctcataggacgcgcccgcatctcccaaggggcaggatggtccctgcgcgagaccgcctgcctaggtaaggcctacgcacaaatgtgggcgttaatgtacttccaccggcgcgacctgaggctggcctcgaacgccatctgtagcgcagtccccgtgcattgggtgcccacctcccggaccacgtggagcatacacgcgcaccatcagtggatgactaccgaagacatgttgaccgtctggaatcgcgtgtggatcgaggacaacccctggatggaggataagacccctgtgactacctgggaggacgtcccgtaccttggtaaacgggaggatcagtggtgcggcagcctgatcgggctaacctcccgcgcgacgtgggcccagaatatcctgacagcgatacagcaggtcaggtccctcatcggtaacgaggagttcttggactacatgccctccatgaagcgcttccggaaggaagaagagagcgagggggccatttggtga

SEQ ID NO: 26216 - RNA, 9873 nt, synthetic construct
  misc_feature 1..9873: note = derived and/or modified CDS sequence (opt11) from DENV-3__AY744683__SS-prME
  source 1..9873: mol_type = other RNA
acctcattatgtctcatgatgatgctgccagccaccctggcattccaccttacctcacgcgacggcgagccccgaatgatcgttggcaagaacgaacgcggaaagagcctgttgtttaagaccgccagcgggatcaacatgtgcaccttaatcgctatggacttgggcgagatgtgtgacgacactgtgacttataagtgccccttgatcaccgaggtggagcccgaggacatagactgttggtgcaacctcaccagcacgtgggtgacctacgggacgtgtaatcaggctggcgagcaccggcgggacaagcggagtgtggccctggcgccccacgttggcatggggctcgacacgcggacccagacctggatgagcgcggagggtgcctggcggcaggtcgagaaggtcgagacctgggcgttccgccaccccggtttcacgatcctggcccttttcctggcgcactacattggcacctcactcacccagaaggttgtgatcttcattctcctgatgctcgtcactccctcaatgaccatgcgttgcgtcggcgtgggcaaccgcgactttgtcgaggggctgtccggggccacctgggtggacgtcgtccttgagcacggcgggtgcgttacgaccatggccaaaaataaacccaccttggacatcgagttgcagaagacggaggctacgcagcttgcaaccttaagaaaattgtgtatcgaaggcaagatcaccaacgtgactacggactcgcgctgccccacccagggcgaggctatactgcccgaggagcaagaccagaactatgtatgcaaacacacttacgtggaccgggggtggggcaacggttgcggcctcttcgggaagggctccctagtaacctgcgccaagttccaatgcttagagtccatcgaaggcaaggctgtgcaacacgagaacctcaagtacacggtgattataaccgtgcacacgggggatcaacatcaggtgggcaatgagacccagggggtcacggccgagatcactccccaggcgtccaccgtcgaggcgattctgcccgaatacggcacgctggggctagagtgttcaccccgcacgggcctggacttcaatgaaatgatcttgctcacgatgaagaataaggcatggatggtgcacaggcaatggtttttcgacttaccgctgccgtggacctccggcgccaccaccgagacgcccacctggaacaagaaggaactcctggtgactttcaagaacgcccacgctaagaagcaggaggtcgtcgtcctggggagccaggagggggcgatgcatactgctctgacaggggccacggagatccagacaagtggcgggaccagtatttttgcgggtcacttaaagtgtcgcctgaagatggacaagctggagctgaagggcatgtcctacgcaatgtgtctgaacgcgttcgtcctcaaaaaggaggtctcagagacgcaacacgggacaatcctaatcaaagtggaatacaagggagaggacgctccctgcaagataccgttcagcacagaggacgggcaaggaaaagcacataacggccggctgattaccgccaaccccatcgtcacgaagaaggaagaaccagttaacattgaggctgaacccccgttcggtgagtctaacatcgtgatcggcatcggggacaaagccctgaagatcaactggtacaagaagggtagctccatcgggaaaatgttcgaggctaccgcgcgtggcgcccggcgcatggcgattctcggagataccgcctgggacttcggttccgtcggcggggttctgaactcccttggcaagatggtgcaccagatcttcggtagcgcatacacggcgttattctccggtgtctcctggatcatgaagatcggcataggggtgctactgacgtggatcggactcaactctaagaacaccagcatgtccttttcttgtattgtgatcggtatcatcaccctgtaccttggcgccgtagtgcaggcggacatggggtgcgtcatcaactggaagggcaaagagttaaagtgcggatcggggatctttgtcacgaacgaggtgcacacatggacagagcagtacaagttccaagccgatagccccaaacggttagccaccgccatcgcaggcgcgtgggagaatggtgtgtgtggaatccgctccaccaccaggatggaaaaccttctctggaaacagatcgccaacgagcttaactacattctgtgggagaacaatataaaactcaccattgtcgttggggacgtaatcggcgtcctggagcagggcaagcgtaccctcacgccgcagcccatggagctcaagtacagctggaaaacgtgggggaaggccaagatagtgaccgcggagacccagaacagttctttcatcatagacggcccgaacacccccgagtgtccgtccgcttcgcgggcctggaatgtctgggaggtcgaggactatgggttcggcgtatttactaccaacatctggctcaagctgcgggagatgtacacccaactttgcgaccaccgcttaatgagcgcagcagtgaaggacgaacgggcggtccacgccgacatgggctactggatcgaaagtcaaaagaatggctcgtggaagctggagaaggccagtctaatcgaggtgaagacatgcacgtggccgaaaagccacacgctgtggtccaacggcgtgctggagagcgatatgataataccgaagtccctcgccgggcccataagccaacacaactatcggcccggatatcatacccaaactgccgggccctggcaccttgggaaacttgagctcgatttcaactactgcgagggcacgacggtagtgattactgaaaactgtgggacccggggcccctccttacgaacgacgaccgtgtccgggaagctgatccacgaatggtgctgtcgtagctgcacgctgccgccccttcgctacatgggtgaggacgggtgctggtacggcatggaaatcagacccattaacgagaaggaggaaaacatggttaagagcctggtttccgccggtagcgggaaggcggacaacttcaccatgggagtgctgtgtctggcgatcctcttcgaggaagtcatgcgcggtaagttcggcaaaaagcatatgattgccggggctttgtttaccttcgtgttgctgctgtccggccaaattacctggcgggacatggcccacactctgattatgatcggctctaacgcgtccgaccgcatggggatgggcgtgacctacctggccttaatagcgacgtttaagatccagcccttcctggctctgggtttcttcctccggaaactgacgagcagggaaaatctgctcctgggcgtcggcctagctatggccaccaccttacagctgccggaggacatcgagcagatggccaacgggatcgctctgggcctcatggccctcaagctaatcacgcagtttgagacgtaccagctctggaccgcgctggtgagcctaatgtgctccaacaccatcttcacgctcaccgtcgcctggcggaccgccaccctgatcctggccgttattagtttactgcctgtgtgccagagtagctccatgcgcaagacggactggctgccgatgaccgttgccgcgatgggagtgccgcccctcccccttttcatcttctctctgaaggacaccttaaaacggcggagttggccgctgaacgagggcgtaatggccgtggggctggtgagtatcctcgcctctagcttcctccgcaatgacgtgcccatggctggcccacttgtcgccggcgggctcctgatcgcttgctacgttattactggcacgtccgcggatctgacagtggagaaggctgccgacgtaacttgggaagaagaggccgagcaaaccggggtgagccataatctcatgatcacggtggacgacgacggcaccatgcgcattaaggatgacgagaccgaaaacattctgaccgtcctgctcaaaaccgcgcttctgatcgtgtccgggatattcccctactctatcccggcgactctcctagtgtggcacacctggcagaagcaaacccagagatccggtgtcctttgggacgtgccctccccgcccgaaacccagaaagcggagttagaagagggcgtgtatcgcattaaacagcaaggcatctttggcaagacacaggttggggtgggagtgcagaaggagggcgtctttcacacaatgtggcacgtgacgcggggcgctgtgctgacccacaacggcaagcggctggagcccaattgggcaaacgtcaagaaggatctcatctcctatgggggcgggtggaaactttccgcccagtggcaaaagggcgaggaggtgcaggtaatcgccgtggagccagggaagaaccccaaaaacttccagacaatgcctggcatcttccaaactactaccggggagatcggggccatcgccttagacttcaagccggggacgtcaggcagtcccatcataaatcgcgagggcaaagtggtgggcctgtacgggaatggcgtcgtgaccaagaacgggggctacgtcagtgggatcgcgcagaccaacgccgagcccgatggtccgacacccgaactggaggaggagatgttcaaaaagcggaacctgactatcatggacctgcaccccggctccggcaagacccgaaaatacctccctgcgatagtcagggaagctataaagcgccgtctgcgcactctgatcctcgcccctacccgggtggtggcggccgagatggaagaggccctgaagggcctgccgatccgctaccaaacgaccgccactaagagcgagcacacggggcgggagatcgtcgacctaatgtgtcacgccacgttcaccatgcgcctgctgtcccccgtgcgcgtacccaactacaacctcatcgtcatggacgaagcccacttcactgacccagcgagcatcgccgccagaggctacatctccacccgggtaggcatgggggaagcggccgcgatattcatgaccgccacgccgcccggcaccgctgatgcgttcccccagagcaacgccccgatccaggacgaagaacgcgacatccccgagcggtcctggaacagcgggaacgagtggattactgatttcgccggcaagacagtgtggtttgtcccttccattaaggccggcaacgacatagcaaactgcctgcgcaagaacgggaagaaagtgatccagctgtcccgcaagaccttcgacaccgagtaccagaagacaaagctgaatgactgggacttcgtagtcacgacggacatctccgagatgggtgcaaactttaaggccgacagggtgatcgacccccggcggtgcttgaagccggtgatcctcacagacggccccgagcgcgtgattctcgccggacccatgcccgtcacggtggccagcgccgcgcagcggcgcggtcgggttggcagaaatccgcaaaaggaaaacgatcagtacatcttcacgggacagcccctaaacaacgacgaggatcacgcacactggaccgaggccaagatgttgctcgataacattaatacacccgaaggcatcatccccgccttattcgaacctgaacgcgaaaagtccgcggccatcgacggggagtatcgcctgaagggcgagagcaggaaaaccttcgtggagcttatgcggcggggtgatctacccgtgtggctggcccacaaggtcgcctcggaggggatcaaatacaccgaccgcaagtggtgcttcgacggcgaacggaacaatcagatcctcgaggaaaacatggacgtggagatctggactaaggagggggagaagaagaaactgcgcccgcggtggctagacgcccgcacctacagcgaccccctcgcgctgaaagaatttaaggatttcgccgccggtcgtaagtcaattgcgctagacctcgtcaccgaaataggacgcgtgccgagccacttggcccaccgtacccgcaacgcattggacaacctcgtgatgctgcatacatccgaacatggtggacgagcgtaccggcacgccgtggaagaactgcccgaaaccatggagaccctcttgctgctcgggcttatgatcctcctcaccggcggggccatgctgttcctgatatcaggcaagggcatcggaaagacttcgatcggccttatttgcgtggtggcctccagcgggatgttatggatggcggacgtacccctgcaatggattgcatccgccatcgtgctagagttctttatgatggtgctgctgataccggagcccgagaagcagcgcacaccccaagataaccagctcgcctacgtcgttataggtattctgacactggccgccatcgttgccgcaaacgaaatggggctactggagaccacgaagcgggacctggggatgtcgaaggagccaggcgttgtgtcccccaccagctacctcgatgtggatcttcaccccgcatccgcatggaccctgtacgccgtggccaccacggtaattaccccaatgttgcgccacaccatcgaaaactcaaccgccaatgtttccctagcggcaatcgccaatcaggctgtagtcctcatggggctcgacaagggctggccgataagcaagatggacttgggggttccgctgctcgccctgggctgctattcccaagtcaaccccctgactctcaccgcggcggtactactgctcgtgacgcactacgccatcattgggccggggctgcaggccaaagcaacccgggaagctcagaagcgcacggccgccggtataatgaagaaccccacggtcgacgggatcatgaccatcgacctggacccggtgatttatgattcaaaattcgagaaacagctcggccaggtgatgctgctggtgctctgtgccgtgcagttgctgctcatgcggacatcatgggccttttgcgaggcgctgaccctggccaccggtccgataaccaccctctgggagggcagccccggcaagttctggaacacaaccatcgccgtgtccatggccaacatattccgcggtagctatttagccggcgctgggcttgccttctccatcatgaagtccgtcggcacagggaagcggggcaccggatcccaaggtgagacgctcggcgagaagtggaagaagaagctgaaccagttaagccgtaaggagttcgacctatacaagaagtccggaataaccgaggtggatagaaccgaggctaaggagggcctcaagcgcggggagataacacaccatgctgtgtcccggggtagcgccaagttgcagtggttcgtcgaacgcaacatggtcatccccgagggccgggtgatcgacctcgggtgcggccgcggcggctggtcgtactactgcgcgggcctgaagaaggtgaccgaggtgcggggctacacgaagggcgggcccggccacgaggaacccgtgcccatgagcacctacgggtggaacatcgtgaagctgatgtccggcaaggatgtgttctacctcccgccagagaagtgcgacacccttctttgtgacatcggagagtcttccccctcgcccaccgtggaggagtcccggacaattagagtcctgaagatggtagagccatggctaaagaacaaccagttttgcatcaaggtgctgaatccctacatgcccacggtcatcgagcatctggagcgcctccagcgcaaacacggcggcatgctggtgcggaaccccctgagccgcaactccacccacgagatgtattggatctccaacgggaccggcaacatcgtttccagcgtcaacatggtatctcggctccttttaaaccgctttacgatgacccatcggcgccccaccatcgagaaggacgtggacctaggggccggcacccggcacgtcaacgcggagccggagacgcctaatatggacgtcattggcgagcgcatcaggcgcattaaagaggaacacagctcaacctggcattacgacgacgagaatccatacaaaacttgggcatatcacgggtcgtacgaggtcaaggcgaccgggagcgcgtcaagcatgatcaacggggttgtaaagctgctcaccaagccgtgggacgtcgtgcccatggttacccagatggccatgaccgacaccactccctttgggcaacagcgggtgttcaaagagaaggtggacacgagaacgccccggccgatgcccgggacccgcaaggtaatggagatcactgcagaatggctctggcggaccttgggaaggaacaagcggcccagactgtgcacgcgggaggagttcatcaagaaggtccgcaccaacgccgcaatgggcgctgtgttcacggaagagaatcaatgggactcggcccgggcggccgtggaagacgaggagttttggaagctcgtagaccgggagcgagagttgcataagctggggaaatgtggctcatgcgtttacaacatgatggggaagagggagaagaagttaggagagttcgggaaggcgaaaggcagccgcgccatctggtacatgtggctgggcgcccggttcttagagttcgaggcactcgggttcctaaacgaagaccactggttcagcagagagaatagctatagcggagtggagggggagggcctgcacaagctcgggtacatacttcgggatatctccaagatccccggcggagccatgtacgctgacgataccgcggggtgggacactcgcatcaccgaagatgacctgcacaacgaagagaagatcacgcagcagatggatcctgagcaccggcagctcgccaacgccatcttcaagctgacctaccaaaacaaggtcgtgaaggtgcagcgcccgacccccaagggcaccgtcatggatatcataagccggaaagaccagcgcggttccggacaggtgggcacgtacggattaaacaccttcaccaacatggaggctcaactaattcggcagatggagggcgaaggggtgttgagcaaggcggacctggaaaacccccatcttcttgagaaaaaggttacgcaatggctggagaccaagggcgtggagcgcctcaagaggatggccatctccggggacgattgcgtggtcaagccgatcgacgaccgcttcgctaacgcactgctggccttgaatgacatgggcaaggtgcggaaggacatcccccagtggcagcctagcaaaggctggcatgactggcagcaggttcccttctgctcccaccacttccatgagctgattatgaaagacgggcggaagctcgtagtgccgtgccggccccaggacgagttgatcggcagagctcggatcagccagggggccggctggtccctgcgcgagacggcctgcctagggaaagcatacgcgcagatgtgggccttgatgtacttccaccgcagggaccttcgcctggcctcgaacgccatatgttccgccgtgccagtccactgggtgccaacaagtcggacgacttggtccatccatgcccaccaccagtggatgactaccgaggatatgctcaccgtgtggaaccgcgtctggatcgaggacaacccgtggatggaggataagacccccgtgacgacctgggaggacgtgccctacctggggaagagggaggaccagtggtgcggcagcctgattggcctcacctccagggccacatgggcccagaacatacttacggctatccagcaagtccggtctctgatcgggaacgaagagttcctcgattacatgccctctatgaaaagattcagaaaggaggaggagtccgagggggccatctggtaa

SEQ ID NO: 26217 - RNA, 9873 nt, synthetic construct
  misc_feature 1..9873: note = derived and/or modified CDS sequence (opt11) from DENV-3__AY744684__SS-prME
  source 1..9873: mol_type = other RNA
accagcctgtgtcttatgatgatgctccccgccaccctggccttccacctcacctcccgcgatggcgagccccggatgatcgtgggaaagaacgagcggggaaaaagcctgctcttcaaaaccgcctccggcatcaacatgtgcacactcatcgccatggacctgggtgagatgtgcgacgacaccgtgacctacaagtgtccgctaatcaccgaggtggagcccgaggacatagactgctggtgcaatctaaccagcacctgggtgacctacggcacctgcaaccaggccggggaacaccggcgcgacaagcggtccgtggccctagcgccccacgtcggtatggggctggacaccagaacccaaacctggatgtctgcggaaggtgcctggaggcaggtcgagaaagtcgagacctgggcttttcgccaccccggttttacgatcctcgccctgttcctagcgcattatataggcacctccctcacacaaaaagtggtgatcttcattttactgatgctcgtcacgccgagcatgaccatgcggtgtgtgggggtgggaaacagagatttcgtcgagggactgtccggggcaacctgggtggacgtcgtcctggagcacggcggttgcgtgacgaccatggcaaagaataagccaaccctcgatatagagctgcagaaaaccgaggccacgcagcttgccaccctccggaaactgtgcatagaggggaaaatcaccaacgtgaccacggacagtcgctgccccacccagggagaagcgatcctgcccgaggagcaggaccagaattacgtctgcaaacacacctatgttgaccggggctggggcaatgggtgcggcctctttggcaagggctccctggtgacctgcgccaagttccagtgcttggaaagcatcgagggtaaagccgtccagcacgagaacctcaagtacacggtgatcataacagtgcacaccggcgaccagcaccaggttggcaacgaaactcagggtgtgacggccgagatcacgccgcaagcatctaccgtcgaagcgatcctgcccgagtacggcactctcgggcttgagtgcagcccccggacaggcctggacttcaacgagatgatcctgctcaccatgaagaacaaggcctggatggtgcacaggcagtggttcttcgacctgccattgccctggacatccggcgctaccaccgagacgcccacctggaacaagaaggaattactggtgacatttaagaacgcgcacgcaaagaagcaagaggtcgttgtcctggggagccaggaaggagcgatgcatacagccctcacaggagctaccgaaatccagacgtcgggcgggacctcgatcttcgccggccacctgaagtgcagattaaagatggacaagctcgagctgaagggcatgtcctacgctatgtgccttaacgcgttcgtcctgaaaaaggaggtgagcgaaacgcagcacgggaccattttaatcaaggtggaatacaaaggcgaagacgctccctgcaagatccccttctccacagaggacgggcaaggcaaggctcacaacggccggcttatcaccgcgaacccaatcgttacgaaaaaggaggagcccgtaaacatagaggcggagccgccgtttggggagtccaacattgtgatcggcatcggggacaaggctcttaagatcaactggtataagaagggtagctcaatagggaagatgtttgaagctaccgcgaggggagcccgacgaatggcgatcctgggggacaccgcctgggacttcgggtctgttggcggggtgttgaactccctcggcaagatggtgcaccagatcttcgggagcgcctataccgccctattctccggcgtcagctggatcatgaagatcggaatcggggtgctgctgacgtggatcggcctcaactccaaaaacacgtccatgtcgtttagctgcatcgtcatcgggataatcaccctgtatttgggcgccgtcgtgcaagcggatatggggtgcgtgatcaactggaaggggaaggaactaaaatgtggctccggaatcttcgttaccaacgaggtgcacacctggactgagcagtacaagttccaggcggatagccccaagcggctcgccactgccatcgcaggggcctgggagaacggtgtttgcggcatcaggtcgacaacgcgcatggagaatctgttatggaagcaaatagccaacgagctgaattacatcttgtgggagaacaacattaaactcaccatcgttgtgggggacgtgatcggagtcctggaacaaggcaagcggaccctaacgcctcagcccatggagctcaagtacagctggaagacgtgggggaaggccaaaatcgtgactgcagaaacccagaattcgtcgttcataattgatggcccgaatacccccgagtgcccgtccgcgagcagggcgtggaacgtgtgggaagtcgaggactacggcttcggtgtcttcactaccaacatctggctgaagcttcgggaaatgtacacacagttgtgcgatcaccgtctgatgtcagctgcagtgaaggacgagcgggccgtccatgcagacatgggctactggatagagtcgcagaagaacggaagctggaagttggagaaagcctccctcatcgaagtgaagacttgcacctggcccaagtcacacacgctgtggagtaacggcgtgctggagagcgacatgatcattccaaagtccctcgccgggcccatcagccagcacaattatcgcccaggctaccatacacagactgcaggaccgtggcatctggggaagctagagcttgacttcaactactgtgagggcacaacggtcgtcataaccgagaactgcgggacccggggcccgtctctacgtaccacgaccgtatcaggcaagctaatccacgaatggtgttgccgctcttgcaccctgccgcccctccgctacatgggcgaggacgggtgctggtatggaatggagatccggcccattaacgagaaagaagagaacatggtcaaaagcctggtgagtgccggcagcgggaaggcggacaatttcacaatgggtgtgctttgcctggccattctgttcgaggaagtaatgcgcggcaagttcggcaaaaagcacatgatcgccggagcattatttacgttcgtgctgctgctgagcggtcaaatcacatggcgcgacatggcccacaccctgatcatgataggcagcaatgcgtccgaccgcatggggatgggcgtgacctatttggccctcatcgcgacgttcaaaatccagcctttcttagcgcttgggttcttcctccggaagctaacttcaagggagaacctgctattaggcgtcggcctggcgatggcaactacgctccagctgcccgaggacattgagcagatggccaacgggatcgccctaggcttgatggccctgaagctgattacacagttcgagacctaccagctctggacggccctagtgtcactgatgtgctccaacaccatatcgacgctcaccgtagcctggcggaccgccacgctaatcctggcggtcatcagcctccttcccgtgtgccagtcttccagcatgaggaaaaccgactggctgccgatgactgtggccgcgatgggggtcccgccgctccctctgtttatcttctctctgaaagataccttaaaacggcgcagctggccgttaaatgagggcgtcatggccgttgggctggtatcgatactagccagctctttcctgcgcaacgacgttcccatggccggccccctggtagccggcggattgctgatcgcttgttacgtgataacgggcacgagcgccgatctcacagtggagaaggccgccgatgtcacctgggaggaggaggccgagcagacgggggtgtctcacaacctcatgataacggtggacgacgacggcacgatgcggataaaggacgacgagaccgagaacatactgaccgtcctgttgaagaccgcgctgttgatcgtgagcggaatctttccctactccatacctgctacgttactggtgtggcacacatggcaaaagcaaacccaacgcagcggcgtgctttgggacgtgccgtcaccgcccgagacacagaaggccgaactcgaggaaggcgtgtaccggatcaagcagcaggggatatttggcaagacccaggtcggggtaggggtgcagaaggaaggggtcttccacacgatgtggcatgtaacccgcggggctgtcctcacccacaacggcaagcggctggagccgaactgggcgaacgtcaagaaggacctcatcagctacgggggcggatggaagctgtccgcgcagtggcagaagggcgaggaggtccaggtgatcgcggtcgaaccaggaaagaacccgaagaacttccagacgatgcctggcatcttccagaccacgaccggcgagatcggggccatcgccctggatttcaagcccggaacaagcgggagccctatcatcaaccgggagggcaaggtggtgggcctttacgggaacggcgtcgtgaccaagaatggtggctacgtaagcgggatcgcgcaaaccaacgcagagcccgacggcccgacccccgagctcgaggaggagatgttcaaaaagcgtaatctgaccattatggacctgcacccgggctctgggaagacccggaagtacctcccagccatagtccgggaggcgataaagcgccggctgcgtacgctgatccttgccccgacccgggtggtggccgctgaaatggaggaggccctgaaaggcctgcccataagataccaaacgacggccactaagagcgaacacaccgggcgggaaatagttgatctcatgtgccatgccacctttaccatgcgactgctgagccccgtgcgggtacccaactacaacctcattgtcatggatgaagcgcatttcacggaccctgcctccatcgccgcgcgcggctatataagcacccgtgtgggaatgggcgaagcggccgccatattcatgacggccacgccgcccgggaccgcagacgcgttcccccagtccaacgccccgatccaggacgaggagcgggacatccccgagaggtcgtggaactctgggaacgagtggatcacagacttcgccggcaagacggtgtggttcgtgccttcaatcaaggccgggaacgatatcgccaactgcctgagaaagaacggcaaaaaggttatacagttgtcccgcaagacgttcgacacagagtatcagaagaccaaactcaacgactgggactttgtggtcacgaccgacatcagcgaaatgggggcgaactttaaggctgaccgggtaatagatccccgccgttgcttgaaacctgtgattctgaccgacggccccgagcgcgtcatcctagccggcccaatgcccgttactgtcgcgtccgcggcccaacggagggggcgcgtcggacgcaacccgcagaaggaaaacgaccagtacatcttcaccgggcagccccttaacaatgacgaggatcacgcccactggaccgaggccaagatgctgttggacaacatcaacacgcccgaaggcatcatccccgccctgtttgaaccagagagagaaaagtccgcggccatcgacggggagtaccgcctgaagggcgagagccggaaaaccttcgtagaactcatgaggcggggcgacctgcccgtatggctggcccacaaggtcgccagcgaggggatcaagtacaccgatcgcaaatggtgcttcgacggtgagcggaataaccagattctcgaggagaatatggacgtggagatctggacgaaggagggtgagaagaagaagttacgcccccggtggctggacgcccgtacttattccgaccccctggccctgaaggagtttaaggactttgccgcgggccggaagtccatcgccctggacctcgtcacagagatcgggagagttccgtctcacttagcacaccgcacccggaacgcgctggacaacctcgtgatgctgcacaccagcgagcacgggggacgcgcttatcgacacgccgtcgaggagctgcccgagaccatggagaccctcctgcttttaggcctgatgatccttctcaccggcggggcaatgcttttcctgataagcgggaagggcatcgggaagacgtccatcggcctcatttgcgtagtggcgagctccggaatgctctggatggctgacgtcccccttcagtggatagcgagtgccatagtgctcgagttcttcatgatggtgctgttgataccggagcctgagaagcagcgcaccccgcaggacaatcagctcgcttacgtcgtgattggtatactgacgctggctgcgatagtggccgcaaacgagatggggctcctggaaactaccaaacgtgacctgggcatgtccaaggagcccggcgtcgtgagcccaacttcctacctcgacgtggacctgcacccggccagcgcgtggactttatacgccgtggctactacggttatcacccccatgctccgccacaccatagagaactccaccgccaacgtgagcttggccgcgattgctaaccaggccgtcgttctgatggggctcgataaaggctggcccatttccaagatggacctgggtgtgccgctgctagctttgggctgctacagccaggttaaccccctgaccctcaccgccgcggtacttctgctcgtgacccactacgccatcatcgggccgggcctgcaagccaaggcgaccagggaggcccaaaaacgcacggctgccggtatcatgaagaacccaaccgtcgacgggatcatgaccatcgatctcgaccccgtgatatatgactctaagtttgagaagcagctcggccaggtgatgctgctcgttctctgcgccgtgcagctcctgctcatgcggaccagctgggccttctgcgaggcgttaacgctagccacagggcccatcaccaccctatgggaaggctcccccggaaagttttggaacacgaccatcgccgtgtcaatggccaacatcttccgcggatcctatctggccggggcagggctggccttctcgatcatgaaatcggtcggcaccgggaagcgggggaccggcagccagggggaaacgctcggtgagaagtggaagaagaagctgaaccaactgtcccgcaaggaattcgacctctacaagaagtcgggtatcaccgaggttgacaggaccgaggccaaggagggcctgaagcgcggcgaaataacccaccatgcagtgtcgcgcggctccgccaagctgcaatggttcgtcgagcgcaacatggttatacccgaggggcgggtaatcgacctcgggtgcggccgagggggctggagttactactgcgcgggactgaaaaaagtcaccgaggtgagaggctacacgaaaggagggcccggccacgaggagcccgttcccatgtccacctacgggtggaacatcgtcaagctgatgagcgggaaggacgtgttctatctcccgcccgagaagtgcgacaccctgctgtgcgacataggggagtccagccccagccccacagttgaggagagccgcaccatacgggtcttaaagatggtggagccctggttgaagaacaaccagttttgcattaaggttctgaatccctacatgcccaccgtcatcgagcatctggaacgcctacagagaaaacacggcggcatgctagtccgcaatcccctgtcccgcaattcgactcatgagatgtactggatctccaacggaacaggcaacattgtttcttctgtcaacatggtgagcaggcttcttctaaacaggttcacgatgactcaccggcgcccgaccattgagaaggacgttgacctcggggccgggacccggcacgtcaacgcggagccggagacgccaaatatggacgtgatcggagagcggattcggcgcatcaaggaagaacactccagcacctggcactacgacgatgagaacccctacaagacctgggcataccacgggtcctacgaggtaaaggccacaggcagcgcatcatctatgataaatggggtcgtgaagctcctgacaaagccgtgggatgtcgtgcccatggtgacgcagatggctatgaccgacaccacgcccttcggacagcaacgggtgttcaaggagaaggtggatacccgcacccctcggccaatgcccggtacccgcaaggtgatggagatcacggccgagtggctctggcgaaccctgggccgcaacaagcgacccaggctgtgcacacgggaggagtttatcaagaaggtgcgcaccaacgccgcgatgggcgccgtgttcacggaagagaaccagtgggacagcgcccgagctgccgtcgaggacgaggagttctggaaactggtggatcgggagcgtgagttgcacaaactgggtaagtgcggctcctgcgtgtataacatgatggggaagcgagagaagaagctcggcgagttcggcaaggcgaaggggagccgcgccatctggtatatgtggctgggcgcccggtaccttgaattcgaggcactcgggtttcttaacgaagatcactggttctcccgcgaaaacagctattccggcgtggagggtgagggtttgcacaagctcgggtacatactgagagacatctcaaaaatccccggcggggcgatgtatgcggacgacaccgccggttgggacaccagaatcactgaggatgacttacacaacgaggaaaagataacgcagcaaatggatccggaacaccggcaactggccaatgcgatcttcaagctgacctaccagaataaggtcgtaaaggtgcagcgccccacgcccaaggggaccgtaatggacatcatctcccggaaagaccagcgcgggagcggccaggtaggcacgtacgggctgaataccttcactaacatggaagcccagctcatccggcaaatggagggcgagggggtgctgagcaaggcggacctggagaatccccacctcctcgagaagaaagtcacccagtggctggagaccaagggcgtcgagcgcttaaagcggatggccatatccggggacgactgcgtggtcaagccgattgatgaccgctttgccaacgccctgctggccctcaacgacatgggcaaagtgcggaaggatattccccaatggcagccctcaaagggttggcacgactggcagcaagtcccgttctgctcccaccatttccatgagcttattatgaaggacgggcgcaagctggtcgtgccttgccggccacaagatgaacttatcggcagagcgcggatctcccagggggccggctggtcattgcgcgagacggcatgcctgggtaaagcttacgctcagatgtgggccctcatgtacttccaccgccgggacttacgtctcgcctccaatgccatctgcagcgctgtgcctgtccactgggtccctacctctcgaaccacttggtccatccacgcgcaccaccagtggatgacgaccgaggacatgttgaccgtgtggaaccgcgtttggatagaggacaacccttggatggaggacaagacccccgtaaccacttgggaggacgtgccctatcttggaaaacgggaggatcagtggtgcggctcgctgatcggattaacctcccgcgccacttgggcccagaacatcctgacggcgattcagcaggtccggagcctgatcggcaacgaagagtttctcgactacatgccctccatgaaacgcttccggaaggaggaggaatcggaaggggccatatggtga

SEQ ID NO: 26218 - RNA, 9873 nt, synthetic construct
  misc_feature 1..9873: note = derived and/or modified CDS sequence (opt11) from DENV-3__AY744685__SS-prME
  source 1..9873: mol_type = other RNA
acttctctgtgcctcatgatgatgctgcccgcaaccctggccttccacctcacctcccgggacggggagcctcggatgatcgtcgggaagaacgagcgcggcaagagcctgctgttcaagaccgcgtccgggatcaatatgtgcaccctcatcgccatggacctgggcgaaatgtgcgacgatactgtcacgtataagtgccccctgatcaccgaagtggagcccgaggacattgactgttggtgcaacctcaccagcacctgggtgacgtacgggacctgcaaccaggccggcgagcaccggagggacaagcggtctgtcgcactggcccctcacgtggggatggggctggacactcggacgcagacgtggatgagcgcggagggcgcctggagacaggtggagaaggtcgagacctgggccttccgccacccggggttcaccatcctcgccctgttcctggcacattatatcggcacctccctcacgcagaaggtggtaatcttcatccttttaatgctcgtcacgcccagcatgaccatgcgttgcgtgggggtcggcaaccgcgatttcgtagagggtctgtccggagccacctgggtggacgtggtcctggagcacggcgggtgcgttaccacgatggccaagaacaagcctaccctcgacattgagctgcagaagacagaggccacacagctggccacacttcggaagctgtgcatcgaggggaagataactaacgtgacaactgactcacgctgccccacccaaggcgaggcgatcctgccggaagaacaggaccaaaactacgtctgcaagcacacctatgtagaccgcgggtgggggaacgggtgcggactcttcgggaagggctccctggtaacctgcgccaagttccagtgcctggagagcatcgagggcaaggccgtccagcacgagaacctcaagtacacggtgatcatcacagttcacaccggggaccaacaccaagtaggtaatgaaatgcaaggggtaaccgccgagatcacgccccaagcgtccaccgtcgaggctatactccccgagtacggcaccctggggctcgagtgcagcccccgcacaggcctggactttaacgagatgatcttgctcaccatgaagaataaggcttggatggtgcaccggcagtggttctttgacctgccgctcccctggacgtccggcgccaccacagagacacccacttggaacaagaaggagctcctggtcactttcaagaacgcccacgccaagaagcaggaggtcgtggtgttgggatctcaggagggcgccatgcacaccgctttaaccggggccaccgagatccaaacttccggcggtactagcatcttcgccggccacctgaagtgcagactgaagatggacaagctcgagttaaagggcatgtcgtacgccatgtgcctgaatgcgttcgtcctgaagaaggaggtaagcgagacccagcacgggaccatcctgattaaggtggagtacaagggcgaggacgcaccgtgtaaaattccgttcagcaccgaggatgggcagggaaaggcccacaacggccggctgatcacggccaaccccatcgtcaccaagaaggaggagcccgtgaacatcgaagccgagccccctttcggggagagcaacattgttatcggcatcggggacaaagccttaaagatcaactggtacaaaaagggcagctcgatcggcaagatgttcgaagccacggcgcgcggcgctcggcgcatggcgatactcggcgacaccgcctgggacttcgggagcgtcggcggggtgttgaactccctgggcaagatggtgcaccagatcttcgggagcgcctacaccgccctcttctccggcgtcagctggatcatgaagataggcatcggtgtgctattaacatggatcggcctaaattccaagaacgcaagcatgtccttcagctgcatcgtaatcgggatcatcacgctgtacctgggcgcggtcgtgcaggccgacatgggttgtgtgatcaactggaagggcaaggagctcaaatgcggttccgggatcttcgtcaccaatgaggtccacacctggaccgagcagtacaagttccaggccgacagccccaagcggctggcgaccgccatagcgggcgcctgggagaacggggtgtgcggcatacgctcaaccacccgcatggaaaatctgctctggaagcagatcgccaacgagttgaactacatcctgtgggagaataacatcaagctcaccatcgtcgttggagacgtgataggcgtcctggagcagggcaagcggacgctgactccccagcccatggagctcaagtacagctggaagacctgggggaaggctaagatcgtgaccgccgagacccaaaattccagcttcatcatcgatggccctaacacccccgagtgcccctcggccctgcgcgcctggaatgtgtgggaggtcgaagactatgggtttggcgtgttcaccaccaacatttggctgaagctccgggagaaatacacgcagctttgcgaccaccgcctgatgtccgctgccgttaaagacgagcgagccgtccacgccgatatgggttactggatagagtctcaaaagaacgggtcctggaagctagagaaggccagcctgattgaggtgaagacgtgcacttggcccaagtcacataccctctggagtaacggcgtgttggagtccgatatgatcattccgaaaagcctggccgggcccattagtcagcacaactatcgccccggctaccacacacagacggcagggccgtggcacctgggtaagctcgagctggactttaactattgcgaaggaacaacggtagtaatcacagagaattgtgggatcaggggcccatcgctgcgcacgaccaccgtgtctgggaagttgattcacgagtggtgctgccggagctgcaccctccctcccttacgttacatgggcgaagacgggtgctggtacggcatggaaatacggccaattaacgagaaggaggagaatatggtcaagtctctcgtaagcgcgggctccgggaagacggacaacttcaccatgggcgtgctgtgcctggctatactcttcgaagaggtcatgagagggaagttcggcaaaaagcacatgattgccggtgcactgttcaccttcgtgttactcctgtctggccagatcacatggagagatatggcccacacgctaatcatgatcggctcaaacgcgagcgaccggatggggatgggcgtgacttacctcgccctgatcgccaccttcaagatccagcccttcttggccctcggcttcttcctgcgtaagttgaccagccgcgagaacttactgctgggcgtcggccttgcgatggccacgaccctgcagctgcctgaggatattgagcaaatggccaacgggatcgccctgggcctaatggccctgaagctcatcacccagtttgagacctatcagctgtggactgcgcttatcagcctcatgtgcagcaacacgatcttcaccctgaccgtggcctggcggacggccacactgatcctcgccgtgatctcccttctaccggtctgtcaaagttcaagcatgcgcaagaccgactggctcccgatgaccgtggccgcaatgggggtcccacccctgcccctcttcatcttctccctaaaggacacgctgaagcggcgcagctggccgttaaacgagggcgtcatggccgtggggctcgtctctatcttggctagctcctttctgcgcaacgacgtacccatggccggccccctagttgctggcggattacttatagcgtgctatgtcatcaccggcacgagcgccgacctcaccgtagagaaggccgctgacgtgacgtgggaggaggaggccgagcagaccggggtctcccacaacctgatgataacggttgacgatgacggcaccatgcgaatcaaggacgacgagaccgagaacatacttaccgttctcttgaagaccgccctgctcatagtcagcgggatcttcccatactccatcccggcgaccctgctggtgtggcacacctggcaaaagcagacgcagcgctccggcgtgttatgggatgttccttcaccgcctgagacacagaaggccgagctggaggagggcgtgtaccgcattaagcagcaagggatcttcggcaaaacccaggtgggggtcggcgtccagaaagagggtgtcttccacaccatgtggcacgtcactcgcggcgccgtactaacacacaacggcaagaggctagagcctaactgggctaatgtgaaaaaggatctgattagctacggcggagggtggaagttgtccgcccaatggcagaaaggcgaggaggtccaggtgatcgctgtggagccaggcaagaaccccaagaatttccagacaatgcccggcatctttcagaccacgaccggcgagattggggccattgccctggacttcaagccgggcacgagcgggtcccccataatcaacagagagggcaaggtcgtgggcctctacggcaacggcgtcgtcaccaagaacggcggatacgtgagcgggatcgcgcagacgaacgccgagcccgatggaccgacccccgaactggaggaagagatgttcaagaaacggaacctaaccatcatggacctccaccccggcagcggcaaaacccgcaagtaccttcccgcaatcgttcgggaagcaatcaagcggcggctgcgcacgctcatcctggcacctacccgggttgtggcggccgagatggaggaggccctgaagggactccccatccgctaccagactacggccacaaagagcgagcacaccgggcgggaaatcgttgacctgatgtgccatgccacctttaccatgcgcttgctcagccccgttcgggtacccaactataatcttatcgtgatggatgaggcgcacttcacggaccctgcctccatcgctgcccgcggctacatctcgacccgggtcgggatgggcgaggcggccgccattttcatgaccgcgacaccacccggaacagccgacgcgttcccccagagtaacgccccgatccaagacgaagaacgagacatcccagagcgatcttggaactccgggaacgagtggatcaccgacttcgccggcaagactgtgtggttcgtgccaagcatcaaagccgggaacgacatcgctaactgcttgcgcaagaacggcaagaaagtaatccagctctcccgcaagacattcgatacggaataccaaaagaccaagctgaacgattgggatttcgtggttaccaccgacatcagcgagatgggggcgaacttcaaggccgatcgggtcattgaccctagacgatgtctgaagccggtgatcctcacggacggccccgagcgcgtgatcttagccggccccatgcccgtcacagtggcctctgcggcgcaacggagagggcgggtaggtcgaaacagccagaaggagaatgaccagtacattttcaccggacagccgctgaacaatgacgaggaccacgcccactggaccgaggccaagatgctgcttgacaacatcaatacgcccgagggcatcatcccagcgctgttcgagcccgaacgcgagaagtccgctgccatcgacggggagtaccggcttaagggggagagccgaaagactttcgtcgagctgatgcgacggggcgatctaccggtgtggctggcacacaaggtggcctccgaggggataaagtacaccgatcgcaagtggtgctttgacggcgaacggaacaaccagatcctggaggagaacatggacgtcgagatctggaccaaagaaggggagaaaaagaagctgagaccccggtggctcgacgcccgcacctacagcgatcccctggccctgaaggagtttaaggacttcgctgcgggccggaagtccattgcactcgacctagtgactgagatcggccgcgtccccagccatctcgcccaccgtacaagaaacgctctcgacaacctggtgatgctgcacacctcagagcacgggggccgcgcctaccggcacgctgtggaggagttgccggagaccatggagactctcctgctcctcggtctgatgatcctcctcaccggcggggccatgttgtttctcattagcgggaagggcatcgggaagaccagcatcggtttgatctgcgtcgttgcctccagcgggatgctctggatggccgatgtaccgcttcagtggattgcttccgctatagtcctagagttcttcatgatggtgctgttaatccccgagccggagaagcagcgcacaccccaggataaccagctggcctatgtggtcatcggcatcctgaccctcgccgcgatcgtggcggccaacgagatggggctactggagactaccaagcgagacttggggatgagcaaggaacctggcgtagtctcacccacttcgtacctggacgtagacctccacccggcctccgcgtggacattatacgccgtcgccacaaccgtcatcactccgatgttacgccataccatagaaaacagcaccgccaacgtgtctctggctgcgatagccaaccaggccgtcgtacttatggggctggacaagggctggcccattagcaagatggatcttggggtgccccttctggcgctgggctgttattcccaggtcaaccccctcactctgaccgcagcggtgttgctcctggtgacacactacgccattatcgggcccggcctgcaggcgaaggccacccgggaggcccagaagaggaccgcagccggaatcatgaagaaccccaccgtggacgggatcatgacgatagatctcgaccccgtaatctatgacagcaagttcgaaaagcagctgggccaggttatgctgctcgtgctgtgcgccgtccaactgctcctaatgcggacctcctgggctttctgcgaggcactgactctcgctaccgggccgattacgaccctgtgggagggcagccccggcaaattttggaacaccactatcgcagtaagcatggccaacatcttcagagggtcttacctcgccggcgcggggctcgccttctccattatgaaaagcgtgggcacggggaagagagggaccggctcgcagggggagacactgggcgagaagtggaagaagaaactaaaccagcttagccgcaaagagttcgacctgtacaaaaagtctgggatcacggaagtcgatcgtacggaggccaaagaaggcttgaagcgcggcgagatcacccaccacgccgtgtcccggggaagcgccaaacttcagtggttcgtggagcgaaacatggtcatccccgagggtcgagtgatcgacctcgggtgtgggcgcggaggctggtcatactactgtgctgggctgaagaaagtaaccgaggtccggggatacaccaagggcgggcccggccacgaggagccggttcccatgagcacatacgggtggaacatagtgaagctcatgtccggaaaggacgtcttctacctgccacccgagaagtgtgacacgttactgtgcgacattggggagagctccccaagcccaacggttgaagaatcccgcacgatccgggtcctcaagatggtagagccctggctgaagaacaaccagttctgcatcaaagtgctgaacccctacatgccgaccgttatcgagcacctcgaacgcctgcaacgcaagcacggcggcatgctggtcaggaacccgctcagccgcaactccacgcacgagatgtactggatatcaaacgggaccggcaacattgtgagtagcgttaacatggtctcccggctgttgcttaatcgctttacgatgacccaccggcgccccacaatagaaaaagacgtggacctgggggccggtacccggcacgtgaatgcagagccggagaccccgaacatggacgttatcggcgagcgcatccggcgcatcaaggaggaacacagctccacatggcactatgacgacgagaatccctacaagacgtgggcttaccatgggtcgtatgaggtgaaggccacaggctccgcatccagcatgatcaatggagtcgtgaagctgttgacgaaaccgtgggacgtagtaccgatggtcacccaaatggccatgacggacacaaccccattcggtcagcaacgggtgttcaaggagaaggtcgacacccgcacgccccggcccatgccgggtacacgcaaggttatggagatcaccgcggagtggctgtggcggaccctgggccgcaataagcgtccccgcctctgcacgcgggaggagtttatcaaaaaggtgcgcaccaacgcggcgatgggggcagtcttcaccgaggagaaccagtgggactccgctcgcgcggctgtggaggacgaggagttctggaagctggtggaccgggagcgcgagctgcacaagctagggaagtgcggtagttgcgtctataacatgatgggtaagagagagaagaagctgggcgagttcggaaaagcaaagggcagtcgcgccatctggtacatgtggctgggcgcgaggtacctcgagttcgaggccctggggttcctcaatgaggaccattggttttccagagagaactcgcacagcggggtggagggggaggggctccacaagctggggtacatcctgcgggacatcagtaagatcccaggcggcgccatgtacgcggatgacaccgcagggtgggacacacgcatcaccgaagacgacctccacaacgaggagaagatcacccaacagatggaccctgagcaccggcagcttgccaacgccatcttcaaactgacctaccagaacaaggtggtcaaagtgcagcgcccgacgccgaagggcacggttatggacatcataagccggaaggatcagcgcgggagcggccaagtaggcacctatgggttgaacaccttcacaaacatggaggcccagctaatccgtcagatggagggcgagggagtgctcagcaaggcggacttagagaaccctcatctgctggagaagaaggtgacacaatggctagagaccaagggcgtcgagcgcttgaaacggatggcgataagtggagacgactgtgtggtcaagcccattgatgaccgcttcgccaacgctctgctcgccctgaacgacatgggcaaggtaagaaaggacatcccgcagtggcagccgtccaagggctggcatgattggcagcaggtacccttttgctcccaccacttccacgagttgatcatgaaagacgggcgcaagttagtcgtcccgtgccggccgcaggacgaactgatcggccgcgcacggattagccaaggtgccggctggtccctgagagagaccgcctgcctcgggaaggcgtatgcgcaaatgtgggccctaatgtattttcaccgccgggacctgcgcctcgcctccaacgccatatgctctgccgtgcctgtgcactgggtccccaccagccggacgacctggtccatccacgcgcaccaccaatggatgaccaccgaggatatgctgacggtgtggaatcgcgtgtggattgaggataacccatggatggaggacaagacacccgtcaccacctgggaggatgtgccctacctaggaaagcgggaagatcagtggtgtggcagcctcatcggtctgactagccgcgcgacctgggcccagaatatactgaccgccattcagcaggtccggtccctcatcggcaacgaggagtttctcgattacatgccgagcatgaaacggttccggaaggaggaggagtccgagggagccatttggtga

SEQ ID NO: 26219 - RNA, 9873 nt, synthetic construct
  misc_feature 1..9873: note = derived and/or modified CDS sequence (opt11) from DENV-3__AY876494__SS-prME
  source 1..9873: mol_type = other RNA
accagcctctgcttgatgatgatgctgcccgcgaccctggccttccacctcacctcccgtgacggggagccccggatgatcgttgcgaaaaatgagcgcgggaaatcactcttatttaagaccgcaagcggcatcaatatgtgcaccctaatcgcgatggacctgggggaaatgtgcgacgacaccgtgacgtataagtgccccctgatcgccgaggtggaacccgaggacatagactgctggtgcaacttaacatcaacctgggtgacctacgggacttgcaaccaggccggggagcatcggcgcgacaagcggagtgtcgccctggcgccgcacgtgggcatggggctagacacccgcacccagacctggatgagcgccgagggggcctggcgtcccgttgagaaggtggagacgtgggcgttgcggcaccccggctttacaatcctggcactcttcctcgcccactacatcgggacttctctgacccagaaggtggtaatctttatccttcttatgcttgtcaccccatcaatgaccatgcggtgcgtcggcgtggggaacagagactttgtcgagggactgtccggtgccacctgggtggacgtggtgctcgagcacggtggctgcgttaccacgatggcgaagaacaagcccaccctggacatcgagctgcagaagaccgaggcaacacaacttgccaccctacggaagctctgcatcgaggggaagatcaccaacgtgacgactgacagccgctgcccgacgcagggcgaggccatcttacccgaggagcaggaccagaactacgtctgtaagcatacttacgtcgaccggggctggggtaacggctgcgggctgttcggaaaagggtccctggtgacatgcgcaaagttccagtgcttagagcccatcgaaggcaaggtcgtgcagcacgaaaacctgaaatacaccgtgattatcacggtacatacaggcgaccagcaccaggtggggaacgacacccagggggttaccgtcgaaatcaccccacaggctagcaccgcggaggccatcctgccggagtacgggaccctcgtgctggagtgctcaccccgtaccggcctggactttaacgagatgatcctcctgaccatgaagaacaaggcgtggatggtgcaccggcagtggttcttcgacctgccactcccttggacgagcggggctaccaccgagaccccgacgtggaaccgcaaagagctgctggttacgttcaaaaacgctcatgcgaagaagcaagaggtggtcgttctcggctcccaggagggcgcaatgcacaccgccctgaccggtgccacagaaatccagaacagcggcggaacctccattttcgccggccacctaaagtgtcgtctcaagatggacaaactggagctgaagggcatgagctacgcgatgtgcctcaacacctttgtgctcaagaaggaggtctccgaaacccagcatggcactatcctaatcaaggtggagtataagggcgaggacgccccctgcaagatccccttcagcacagaggacggacagggcaaggcccacaacgggcgcctgatcactgccaaccccgtggttacaaagaaggaggagcccgtgaatatcgaagcggaaccgcccttcggggagtcaaacatcgtgatcgggatcggggacaaggcattaaagatcaactggtataagaagggctccagtatcgggaaaatgttcgaggcgacggccaggggcgcccgtaggatggcgatcctgggcgacaccgcttgggacttcggctccgtcggcggggtgctgaacagcctcggcaagatggttcatcagatctttgggtcggcctacacggctctgttcagcggcgtctcctggattatgaagatcgggattggcgtgctgctcacctggatcggcctgaatagcaagaacacttccatgagtttctcgtgcatcgtgatcgggataatcaccttatatctaggcgctgttgttcaggcggacatggggtgcgtgataaactggaaaggcaaggagctcaagtgtgggagcggcattttcgtcaccaacgaggtgcacacctggacggagcagtacaagttccaggccgattccccgaaacggctggcgacagctatcgccggggcgtgggagaacggcgtctgtggaatacgcagcactaccaggatggaaaacctcctgtggaagcaaatcgccaacgagctgaactatatcctgtgggagaacaatataaagctaacggtcgtggtgggcgacatcatcggcgtcctggagcagggcaagcgcaccctcaccccgcaacccatggaattgaagtactcctggaaaacctggggcaaggccaagatcgtgactgccgagacacaaaacagctcctttatcattgacgggcccaacacccccgagtgcccgtcagcgtcgcgggcctggaacgtgtgggaagtagaggactacggcttcggcgtgttcaccacgaacatctggctgaagctccgcgaggtgtacacgcagtcatgcgaccatcggttaatgagcgcggccatcaaggatgaacgggccgtccatgctgacatgggatactggatcgagtcccagaaaaacggcagctggaagctggagaaggcctcctttatcgaggtgaaaacgtgcacgtggcccaagtcgcacacactctggtcaaatggcgtgctggagtctgacatgatcatccctaaatccttggccgggccgatctcgcaacacaatcacagacccggctactacacgcagaccgcagggccctggcacctcggcaagctggagctggatttcaattactgcgaggggaccaccgtagtgatcacggagaactgcggcacccgcggcccttccctgcggactaccaccgtgtcaggcaagctgatccacgagtggtgctgccgctcatgcaccctgccgcccctccggtacatgggcgaggacgggtgctggtacggcatggagatccgccccatcaacgagaaggaagagaatatggtcaagagcctggtaagcgccgggagcggcaaggtcgacaacttcaccatgggggtcctgtgtttagcgatcctgttcgaggaggtgatgcgagggaagtttggtaagaaacacatgatagccggggtgctctttacttttgttctcctgctctccggccagatcacgtggagagacatggctcacacactcatcatgattgggtcgaacgcctccgaccggaccggaatgggggtgacttaccttgctctgatcgctacgttcaagatccagccattcctcgccctggggttcttccttcgcaaactcaccagccgggagaacctgctgctcggagtggggctggcgatggccaccaccttacagctcccggaggacatcgagcagatggctaatggcatcgcgctggggctgatgacgctcaaattgatcacgcagttcgaaacctaccagctttggactgccctcgtgagcctcacgtgctccaacaccatatttaccctgacggttgcctggcgcacagcgaccctcatcctggcgggggtcagtctgttgcccttatgccagtcgtcatccatgcgcaagaccgactggttacccatgaccgtcgccgccatgggcgtgccgccgttgcccctgttcatctttagcctgaaggacactcctaaaagacgctcctggcccctgaacgagggggtcatggctgtgggcctggtgtcgatcctggcctccagcctccttcggaacgacgtcccgatggcgggacccctcgtggctggcggcctcctgatcgcctgttacgtgatcaccgggacgtcggccgatctgaccgtcgaaaaagccgcagacgtaacgtgggaggaggaagctgaacagaccggagtgagccacaatctcatgatcaccgtcgacgatgacgggaccatgcgcatcaaggatgacgagacggagaacatccccacggtgctgctgaagaccgcccttctaatcgtgtccggcatctttccctacagcatcccggccaccctgctggtctggcatacttggcaaaagcagacccagcggtcgggggtgctgtgggacgtccccagcccgcccgagacccagaaggccgagctggaggaaggcgtctaccgcatcaagcagcagggcatcttcgggaaaacccaggtgggcgtgggggtacagaaggagggcgtgttccacaccatgtggcacgttacgcggggcgccgtcctcacccacaacggcaagagactggagccgaattgggcttccgtgaagaaggatctcatcagctacggcggtggctggcggctctccgcccagtggcagaaaggggaggaggttcaggtaattgccgtggagcccgggaagaaccccaagaacttccagaccatgccggggatcttccagaccactactggcgagatcggcgcaatcgccctggacttcaaacccgggaccagcggctcgcccattatcaaccgcgagggtaaggtggtcggactgtacggcaacggggtagtcaccaagaacggcgggtacgtatccggcatagcgcagacaaacgccgagcccgacgggcctacgcccgagctggaggaggagatgttcaagaagcgcaatctaaccatcatggacttgcaccccggtagcggcaaaacacgcaagtacctgcccgcgatagtgcgggaagcgatcaagcggaggctccgcacgctgatcctggcccccacccgggttgtggccgccgagatggaagaggccctcaaagggctgcccatccgctatcaaaccacggcgacgaagtccgagcacacgggccgggaaatcgtcgatctgatgtgccacgcaacattcaccatgcgcctactgagccccgtacgggtacccaactacaacctgataataatggatgaggctcacttcacggacccggcatctatcgcggcgcgcggatacattagcactcgggttggcatgggggaggccgcggccatcttcatgactgcgacaccgcccggcacggccgaggccttcccccagtccaacgcgccgatccaagacgaggagcgcgacatacccgaacgcagttggaactccggcaacgagtggatcactgacttcgttgggaagaccgtctggtttgtcccctcaatcaaagctggtaacgacatcgcgaactgtctccggaaaaacgggaagaaggtgatccagctgagccgcaagaccttcgatacggagtatcagaagacccggctgaacgactgggactttgtagtaaccaccgacatcagcgagatgggcgccaatttcaaggccgatcgcgtgatcgatccccgtcgctgcctcaagccggtcatcctgaccgatgggcccgaacgtgtgatactggctggcccgatgcccgtgaccgccgcaagtgccgcacaacgccggggacgcgtcggacggaacccgcagaaggagaacgaccaatacatatttaccggccagcccctcaacaatgacgaggaccacgcccattggactgaggccaagatgctgctggacaacataaacacccccgagggtatcatacccgccctattcgaaccggagagggagaagtccgcggccatcgatggcgagtaccggctgaagggtgagtcccgcaagacgttcgtggagctgatgcggcgcggtgaccttcctgtctggctggcccataaagtggcgagtgaggggatcaagtacacggacagaaagtggtgtttcgacggggagagaaacaaccagattctggaggaaaatatggacgttgagatctggaccaaggaaggcgaacggaaaaagttgagaccccgctggctggacgcccggacttactccgaccctctggcactcaaggagttcaaggacttcgccgccggccgaaagagcatcgccttggacctggtcacggagatcggccgtgtgccctcccacctcgcgcatagaactcgaaacgccctggataacctggtgatgctccacaccagcgaacacggcggcagggcctaccggcacgccgtcgaggaacttccggagaccatggaaacactgctcctgctcggtctcatgatcctgcttactgggggcgcgatgctgttcttgatttctgggaagggcatcggcaagacctccatcgggttgatatgtgtaatagtgtcctctgggatgctctggatggccgacgtccccttgcagtggatcgcgtcagctatagtgttggagttcttcatgatggtactcctgatcccggagccagagaagcagcgcacgccccaggacaaccagctggcttacgtcgttattgggatccttacgctggcggccattgtagccgccaacgagatgggactgctcgaaaccaccaagcgggacctgggcatgtccaaggagcccggcgtcgtgtccccgacctcatacttagacgtggacttgcaccccgcctcggcatggacactgtacgccgttgccaccaccgtgataacccccatgttgcgtcacactatcgagaactccaccgccaacgtgagcctcgccgccatcgccaatcaggcggtcgtgctaatgggcctggacaaagggtggcccatctccaaaatggacttgggcgttcccctgctcgcactcggttgctactctcaggtcaaccctctgaccctgacggcggcagtgctgcttctggtgacgcactacgccatcatcggccccgggctccaggccaaggccacccgggaggcgcaaaagcgcacagccgcggggatcatgaagaatccgaccgtcgacggcatcatgacgatcgacctggacccggtgatctacgactccaagttcgagaaacaactgggccaagtgatgctcttagtcctctgcgccgtgcagctcctgctgatgagaaccagctgggcgctctgcgaagcgctgacactggccaccggccccatcacgactttatgggaggggtcccccggcaagttctggaacaccacaatcgccgtgagcatggccaacatctttcgcggctcctacctggcgggggcggggctggccttcagcatcatgaagtccgtcgggacgggcaaacgggggaccggctcccagggcgaaactctcggggagaagtggaagaagaaattaaaccagctgtcacgcaaagagttcgatctctataagaaatccggaatcaccgaggtggaccggaccgaggccaaagagggactgaagagaggcgagacgacccaccacgccgtgagccgggggtccgcgaaattacaatggttcgtcgagaggaacatggttatccccgagggccgggtcatcgacctcgggtgcggtcgcggcgggtggtcatactactgcgccggcctgaagaaggtcactgaggtgcgcgggtatacgaagggcggtcctgggcacgaggaacctgtgcccatgagtacgtacggatggaacatcgtcaagctgatgagcgggaaggacgtgttctacctacccccggagaaatgcgacacattgttatgtgacatcggcgagtccagcccctcccccaccgtcgaggaatcacggaccatccgtgtactgaagatggtagagccctggctcaagaacaaccaattctgcatcaaggtgctgaacccctatatgcccacggtcatcgagcacctggagaggctccaacggaagtacgggggcatgctggttcgtaaccctctgtcccgcaactctacccacgagatgtactggatttcgaacggcacggggaatattgtgtcgtccgtcaacatggtgagtagactactgctgaatcgcttcaccatgacgcaccggcgtccgaccatcgagaaagacgtcgacctcggcgccgggacgcggcacgtcaacgccgagcccgagacacccaatatggacgtaatcggcgaacgcatcaagagaataaaagaggaacactccagcacatggcactacgatgacgagaacccctataagacctgggcgtaccacggatcctacgaggtcaaggcgaccgggtccgctagctccatgataaacggtgtcgtcaagctgttaaccaagccgtgggatgtggtgccaatggtgacgcagatggccatgaccgacaccacccccttcggccaacaacgcgtattcaaggagaaagtggacacgcggacaccgcgcccgatgccaggcacccgtaaagtgatggagattacggccgagtggctctggagaacgctggggcggaataagcgcccccgcctgtgtaccagagaggagtttacgaagaaggtccgaaccaacgcagcgatgggcgcagtgttcacggaggagaaccagtgggacagcgcccgggcagcggtggaggatgaagagttctggaacctctgggacagggagcgggagctacacaagctgggcaagtgcgggtcctgtgtctacaacatgatgggcaagcgggagaagaagttaggggagttcggcaaagccaaggggtcgcgggccatctggtacatgtggctgggcgcgcgctacctggagttcgaggccctgggcttcctgaatgaagatcactggttctcccgggagaacagctatagcggtgtggagggggagggactgcacaagctcggctacatcctacgcgacatctctaagatccctgggggcgcgatgtatgccgacgacactgcgggatgggacacccgaattacagaggacgaccttcataacgaggagaagatcacgcagcagatggaccctgagcatcgccagctcgccaacgccatcttcaaactgacctatcagaacaaggtggtcaaggtgcagaggcccacccccaaggggacagtgatggacatcatatcgcgaaaggaccagcgggggagtgggcaggtcggcacctacggcctgaacacgtttaccaacatggaggcacagctagtacggcagatggagggggagggcgtgctgtccaaggctgaccttgagaatccccacctccttgagaagaagatcaccccatggctggaaccaaagggggtcgagcggctcaagcgcatggccatcagcggcgacgactgtgtggtaaagccaattgacgaccgtttcgctaatgccctgctggcgctcaatgacatggggaaggtccgcaaggacataccccagtggcagccgtccaagggctggcacgactggcagcaggtccccttctgcagccaccacttccacgagctgatcatgaaggatggtcggaagctggtggtaccctgccgcccacaggacgagctaatcgggcgcgcgaggatctcccagggcgcggggtggagtctgaaggaaaccgcctgcctggggaaggcttatgcgcaaatgtggtccctcatgtatttccaccgccgggacctgcgattggccagcaatgccatctgctccgccgtgccggtgcactgggtccccacgagccggactacctggagcatacacgcgcaccaccaatggatgacgacggaggacatgttaaccgtgtggaaccgcgtgtggatagaggacaatccctggatggaagacaagaccccggtcaccacctgggaggatgtaccctaccttggtaagcgggaagaccaatggtgcggctccctgattggcttaaccagccgaagcacttgggctcagaacatcctgaccgccatccaacaggtccggagcctgatcggggatgaggaatttctcgattacatgccctccatgaagcgcttccggaaggaggaggagagcgagggggctatatggtaa

SEQ ID NO: 26220 - RNA, 9873 nt, synthetic construct
  misc_feature 1..9873: note = derived and/or modified CDS sequence (opt11) from DENV-3__AY923865__SS-prME
  source 1..9873: mol_type = other RNA
accagcctttgcttaatgatgatgctgcccgccacgctggcctttcacctcacgagccgggatggcgagccgcggatgatcgtgggaaagaacgagcggggaaagagcctgctgttcaaaaccgcgtccgggatcaacatgtgtaccctgatagccatggacctgggcgagatgtgcgacgacaccgtgacctacaaatgtcctctgatcgccgaggtcgagccagaggacattgactgctggtgcaacctcaccagcacctgggtaacctacgggacctgtaatcaagccggcgagcaccggcgagacaagcgttccgtggccctggcgccccatgtgggaatggggctggatacccgcacccagacctggatgagcgctgagggagcctggcgccaagtggagaaggtggaaacctgggccctccgccacccggggtttaccatcctggcgttgttcttggcccactatattggaacctctctgacccagaaagtggtgatattcatcctgctcatgttagtcacgccatcaatgacaatgcggtgcgtgggggtaggcaatcgcgatttcgtggaaggcctgtccggagccacctgggtggacgtcgtcctcgagcacggcgggtgtgtgaccacgatggccaagaacaagcctaccctggacatcgagcttcaaaaaacggaggccacccagctcgcgacgcttcggaagttatgcatcgagggcaagatcaccaacatcaccaccggctcacgttgccccacgcaaggggaggctatcctcccggaggagcaggatcagaactacgtgtgtaaacacacctacgttgaccggggctggggtaacggctgcggtttattcggcaagggcagtttagttacgtgtgccaagtttcagtgtctcgagccgatcgaggggaaggtggtccaatacgaaaacctcaagtataccgttatcataacggtccacaccggcgatcagccccaggtcggtaacgacacccagggtgtgacggtcgagatcacgccgcaagcctccaccgtggaggctgtgctgctcgagtacgggacgctgggcttaaagtgctcaccgcgcaccggcttggatttcaacgaaatgatcctactgaccatgaagactaaggcttggatggtacaccggcagtggttcttcgacctacccctgccgtggacctcaggggccaccaccgagacgcccacgtggaaccgaaaagagcttctcgtgaccttcaagaatgcccacgcgaagaagcaggaggtggtcgtgttaggctcgcaggagggtgccatgcataccgcccttacgggcgccaccgagatccaaaacagcggggggaccagcatcttcgctgggcatctcaagtgtcgtctaaagatggataagctggagctcaaagggatgagctatgccatgtgcctcaacaccttcgtgctgaaaaaggaggtgagcgagacgcagcacggcaccatcctgattaaggtggaatataagggggaggatgctccgtgcaagatcccgtttagcactgaagacggccagggcaaggcgcataacgggcgcctcatcaccgcgaatcccgtggttacgaagaaggaagagcctgtcaacatcgaggccgagccgcccttcggcgagagcaacatcgttatcgggatcggcgataaggccctgaagattaactggtacaagaaggggtcatctatcgggaagatgtttgaggctacggcccggggtgcacgtcggatggccatcctcggcgacaccgcctgggacttcggctccgtcgggggcgtgctcaacagcctcggtaagatggtccatcagatcttcggttcggcgtacaccgcgctgttctcgggtgtatcctggatcatgaagatcgggataggggttctcctgacgtggatcggactgaactccaaaaatacctccatgagtttctcctgcatagtgataggcatcatcaccctctacttgggggccgtcgtccaagccgacatgggctgcgtgatcaactggaagggcaaggagctgaaatgtggaagcggtattttcgtcaccaacgaagtgcatacgtggaccgagcaatacaagttccaagccgactcccccaaacgcctcgcaacagctattgctggagcatgggagaacggtgtatgcgggataagaagcacgacgcggatggagaatctgctctggaagcaaatagcgaatgagttgaattacatactgtgggagaacaacatcaagttgaccgtcgtagtgggcgacatcatcggcgtcctcgagcaggggaagcggaccttgacgccgcagccgatggagctaaagtactcctggaagacgtggggcaaggctaagatcgtcaccgcagagacccaaaacagctccttcatcatcgacgggcctaacaccccagagtgccccagcgcctcccgggcgtggaacgtgtgggaggtcgaagactacggctttggagtcttcacaaccaacatttggctcaagttgcgagaggtgtacacccagagctgcgaccaccggctgatgagtgcggctataaaagacgagcgcgcggtccacgcagacatggggtactggatagagtcccaaaagaatgggagttggaagttagagaaggcctccttcatcgaggtgaagacctgcacctggcccaagagccacacactgtggtccaacggggttcttgagtctgacatgataataccaaagtccctggcgggcccgatcagccagcacaaccatcggccggggtaccatacccagaccgccggcccctggcacctaggtaaactcgagctcgacttcaactactgcgagggaaccacggtcgtcatcactgagaactgcggcacccgcggcccgtcccttcgcacaacgacggtgagcgggaagctgatccatgagtggtgctgtcgctcctgcaccctgccacccctgcggtacatgggcgaggacggatgctggtacggcatggagatacgcccgatcaacgagaaagaggaaaacatggtcaagagcctggtcagcgccgggagcggcaaggtggacaactttactatgggggtcctctgcctggctatactcttcgaggaggtaatgcggggcaagttcgggaaaaagcacatgatagccggcgtcctcttcacgttcgtgctactgttgagtggccagataacctggagagacatggctcacaccctcatcatgattgggtcgaacgcctccgaccgcatgggcatgggggtgacttatttagcgttaatcgcgacgtttaagatccagcccttcctggcacttgggttcttcctccgcaagctgacctcacgggaaaacctgttattgggcgttggtctcgcaatggctaccaccctacagttaccggaggacatagaacagatggcaaacggaatcgcattggggctcatgacgctgaaactgatcacccagttcgagacctaccagctgtggacagcgctggtcagcctcacatgcagcaacaccatcttcaccctcaccgtggcctggcgtacggccacccttatcctcgccggcgtcagcctcctgcccctgtgccaatcctcgtccatgaggaagaccgattggctacccatgactgtggccgcgatgggggtgccgccgctacctttgttcatattttcactaaaggacacgcccaagcgccgctcttggcccctgaacgagggtgtaatggccgtaggcctggtcagcatcctggcctctagcctgctgcggaatgacgtacccatggccgggccgctggtggccggcgggcttctgatcgcgtgctacgtgatcaccggcacctccgccgacctcacagtcgaaaaggccgcggacgtaacgtgggaagaggaggccgagcagaccggggtgtcacataacctgatgatcaccgtggacgatgacggcaccatgagaataaaggatgacgagactgagaacatactaacggtactcctgaaaaccgcgctcctcatcgtgtccgggatcttcccctacagcatccccgccaccctcttggtttggcatacctggcagaagcagacgcaacggtccggggtgctctgggacgtgcccagtccgcccgagacccagaaagcggaacttgaggaaggcgtctaccgcataaagcaacagggcatcttcggcaagacgcaggtaggagtgggagtccagaaagagggggttttccacaccatgtggcacgtcacgcgcggggccgtcttgacgcacaacggcaagcgcctcgagcccaactgggcctccgttaagaaggacctgatctcatacgggggcgggtggcggcttagtgctcagtggcaaaagggggaggaggttcaggtcatcgccgtggaacccggcaagaatccgaagaacttccagacgatgcccgggattttccagaccacgaccggagagatcggtgccatcgccttggacttcaagccgggcacaagcggcagcccgatcatcaaccgcgaggggaaggtggtcggactctacggaaacggcgtagtgaccaaaaacgggggctatgtctccgggattgcacaaactaacgccgagcctgacgggcccacgccagagctggaggaggagatgttcaagaagaggaacctgaccatcatggacctccacccgggaagcgggaagacccgcaagtacctgcccgccatcgtacgtgaggccatcaagcgccggctgcgcaccctcattctggcccccaccagagtagtcgcggccgagatggaggaggccctgaagggtctccctatccgctaccagaccaccgcgacgaaaagcgagcacaccgggcgggagattgtggacttgatgtgccacgccacctttaccatgcgcctgttgagccctgtgagagtacccaattataacctgatcatcatggacgaggctcacttcacggacccagcctctatcgcagcccgaggctacatctcaacccgggtcggtatgggggaggcggcggccatctttatgacagccacgccgccaggcacggccgaggcgttcccccaatctaacgcccccatccaggatgaggaacgcgacatcccagagcggtcgtggaactccggcaatgagtggataacggatttcgtggggaagaccgtgtggttcgtgccgagcatcaaagccgggaacgacatcgccaactgcctccggaagaacggcaagaaggttatccagctctcccgaaagactttcgacacagagtatcagaagacacggctgaacgactgggactttctggtaactaccgatatcagcgaaatgggtgccaactttaaggcggaccgcgttatcgacccccggcgatgcctcaagcccgtgatcctgacggacgggccggagagagtcatattggcgggcccgatgcctgtgacagccgcatccgcagcgcaacgtcgggggcgcgtgggccgaaacccccaaaaggagaacgatcagtacatattcaccggacagccgctcaacaacgacgaggaccacgcgcactggaccgaggccaagatgctgctggataacataaacactccggagggaatcatccctgctttatttgaacccgagcgcgaaaagtcagccgcgatcgacggcgagtacagactgaagggggaatcccgtaagacgtttgtcgaactgatgcgccggggagacctccccgtgtggctggcccataaggtcgcctctgaggggatcaaatatacagaccgaaagtggtgttttgacggcgagcgcaacaaccaaatcctggaggagaatatggatgttgaaatatggacgaaggagggagagcggaagaagctccgcccgagatggctggatgcccggacctactccgatcccctggcgctcaaagagttcaaggacttcgccgccggccgcaagagtatcgccttggatttggttacggagatcggacgtgtccccagtcacttagcccaccgcacccgcaacgccctggataatcttgtgatgctccacaccagcgagcacgggggccgcgcctatcgccacgccgtggaggaactccctgagaccatggagacgcttctcctgttggggctcatgatcttgcttaccggcggcgcgatgttatttttgatcagcgggaagggaatcgggaagacgtccataggcctaatttgtgtcatcgtgtcttccgggatgctctggatggccgacgtgcccttgcagtggatcgcgtcagccattgtcctggagttcttcatgatggttcttctgatccccgagcccgagaagcagaggaccccacaggacaaccagcttgcctacgtcgtcatcggcatactcactctggccgccatcgtggcggccaacgagatgggcctgttggagaccacgaagcgggatctcgggatgtccaaggagccgggtgtggtcagccccacttcctacctcgacgtggatctccaccccgccagcgcctggacgttatacgccgtggccaccaccgtcatcacccctatgctacgccacaccatcgagaactccactgcaaacgtgagcttggcggccatcgcaaaccaggcggtcgtgctgatggggctggacaagggctggcccatctctaagatggatctgggggttcccctgctagccctcggctgctacagccaggtgaatccactaaccctgaccgcggccgtcttactgctcgtaacgcactacgcgatcatcggcccggggcttcaagcaaaggcgacccgggaggcccagaagcgcaccgccgcgggaatcatgaagaaccccaccgtggacgggatcatgacgatagatctggaccccgttatctacgactccaagttcgagaagcagctggggcaggtaatgctcttggtcttatgcgcagtccagctcctgctgatgcggaccagctgggccctctgcgaggcactgaccctggctacaggccctatcacgaccctctgggaggggtccccgggcaaattttggaataccaccatcgccgtgagcatggccaatatcttccgtgggtcctatctggcaggaacggggttggcgttctcgataatgaagtccgtgggcaccggccgtcgcggaaccggcagccagggggaaaccttaggcgagaagtggaagaagaagctgaaccagttaagccgcaaagagttcgacctctacaagaagtccgggatcactgaagtagatcgcaccgaggcaaaagaaggactgaaacgtggcgaaaccacccaccacgccgtgagccgcggttctgcaaagctgcagtggttcgtagagcggaacatggttatccccgagggacgggtcatcgacctcgggtgcggacgcgggggctggagctactattgcgctggcctaaagaaagttaccgaggtgagagggtacacgaagggcggacctggccacgaagaacccgtgcctatgtccacttacgggtggaacatcgttaagctaatgagcggcaaggacgtcttctatctgccgcccgagaagtgcgacacactactgtgtgacatcggtgaatcctctccctctccgaccgtggaggagagccgcacgatacgggtcctaaagatggtcgagccctggctcaagaacaatcagttttgcatcaaggtcctaaacccctacatgcccacagtgatcgagcatctggaacgcctccagcgcaagtacgggggcatgttggtcaggaatcctttgagtcgcaatagcacccacgagatgtactggatttccaacgggacgggtaacatcgtgtcgtccgtgaacatggtatcaagactactgctgaacagattcacgatgacccatcgtcggccgaccatagagaaggatgtcgacctcggcgcaggcacccgccacgtcaacgcagagcccgaaacgccgaacatggacgtgattggcgagcggatcaagcgcatcaaggaggagcactcctcaacctggcactacgacgatgagaacccctacaaaacctgggcttatcacggcagttacgaggtgaaagccacgggcagcgcctcttccatgatcaacggcgtcgtgaaactgctgacaaagccctgggacgtggtccctatggtgacccagatggccatgacggataccacgccctttggccagcagcgggtattcaaagaaaaggtcgacacacgcacgccccggccgatgcccgggacgcgcaaggtgatggagatcacggcggagtggctctggaggaccctgggccgcaacaaaaagccgcgcctgtgcacccgggaagagtttactaaaaaggtgcgcacgaatgctgcaatgggcgcggtcttcacggaggaaaaccagtgggatagcgctcgggcggcagttgaggacgaggagttctggaaactcgtggatcgcgagcgggagctgcacaagctagggaaatgcgggagctgcgtgtacaacatgatggggaagcgcgagaaaaagctaggggagttcggaaaagccaaggggagccgggccatttggtacatgtggctgggcgcgcggtacttagaattcgaggcccttggctttctaaacgaggaccactggttctcccgggagaacagctactccggtgtggagggagagggtctgcataaactcggctatatcttgcgcgacatcagcaaaatcccagggggggccatgtacgccgatgacaccgcagggtgggatacccggattacagaggacgatctccacaacgaagagaagatcacccagcagatggaccctgagcaccgtcagctcgcgaacgcaatcttcaagcttacctaccaaaacaaggttgtcaaggtgcagcggcctacccctaagggcacggtaatggacatcatctcccgtaaggaccagcggggcagcggccaagtcgggacttacgggctgaacaccttcaccaacatggaggcccaactcgtgcgccaaatggagggcgaaggcgttctgtctaaggcggacctagagaaccctcacctattggagaagaagatcacccagtggctagagacgaagggcgtcgagcggctcaaacgcatggccatcagcggggacgactgcgtcgttaagcccatcgacgatcggttcgcgaacgctctactggcactcaacgacatggggaaggtcagaaaggatattccacagtggcagccgtccaaggggtggcacgactggcagcaggtacccttctgcagccatcatttccatgagttaatcatgaaggacggcaggaagcttgtggtcccttgccgcccccaggacgagctgatcggcagagctcggatcagtcagggggccggctggagcctgaaggagacggcctgcctgggtaaggcttacgcgcaaatgtggtcgctcatgtacttccatcgcagagacctgcgcctggccagcaacgccatctgctccgctgtcccggtccattgggtccctaccagccggaccacgtggtctatccacgcgcaccatcagtggatgaccacagaggacatgctcaccgtatggaatagagtgtggatcgaggacaacccctggatggaagataaaacaccagtcactacctgggaggacgtgccgtacctgggaaagcgggaggaccagtggtgcggctccctgattgggttgaccagccgcgccacttgggcacagaacatcctgacagcgattcaacaggtccgctccctgatcggtgatgaggaattcttggactacatgccctcgatgaagcgcttcaggaaggaggaagagtccgaaggggccatctggtga

SEQ ID NO: 26221 - RNA, 9867 nt, synthetic construct
  misc_feature 1..9867: note = derived and/or modified CDS sequence (opt11) from DENV-4__KR922405__SS-prME
  source 1..9867: mol_type = other RNA
tctaccataaccctgctctgcctaatccccactgttatggccttccatctgtccactagggacggcgaaccgcttatgatcgtcgcaaagcacgaacgcgggcgacccctgctgttcaagaccacggaagggatcaacaagtgtacccttatcgcgatggacctaggggagatgtgcgaggacaccgttacgtacaagtgccccctgctcgtcaacaccgagccagaggatatagactgctggtgtaacctgaccagcgcctgggtcatgtacggcacgtgcacccaatccggtgagcggcgccgggaaaagcgatcagtggccctgaccccgcattccggcatgggtctcgaaaccagggctgaaacttggatgagctcagaaggcgcctggaagcacgcccaacgcgtggagagctggattctgcggaaccccgggttcgcactgttagccgggtttatggcatatatgatcggtcagaccgggatccagcgcaccgttttcttcatcctgatgatgctcgtggcaccgtcctacggcatgaggtgcgttggcgtaggtaaccgcgacttcgttgagggggtgagcgggggcgcctgggtcgatctcgttctggaacatggcgggtgcgtgaccaccatggcccaggggaagccaaccctggatttcgagctcatcaagaccacggccaaggaggtcgctctattacggacgtattgcatcgaggcctcaatcagcaacatcaccacagccacacgatgccctacccagggtgagccctacttgaaggaggaacaggaccaacagtacatctgccgtcgagacatggtggaccgaggctggggtaacggctgtggcctgttcgggaaaggcggggtcgtaacctgcgccaaattctcctgcttagggaagatcacaggtaacctcgtgcagatcgagaacctggagtacacggtagtcgtgacggttcataacggcgatacccacgccgtcggcaacgacacaagcaaccacggggtaactgccaccattacaccgcggtctccttccgttgaagtgaaattaccagactacggggagcttaccctggactgcgagccacggtccgggattgacttcaacgaaatgattttaatgaagatgaagacgaaaacttggctagtgcacaagcagtggttcctggatttgcccctcccttggacaaccggcgcggacacgctcgaggtacactggaaccacaaggagcgaatggtcacgttcaaggtcccgcacgccaagcggcaggacgtcaccgtcttggggagccaggagggtgccatgcacagtgctttggccggtgcgaccgaggttgactctggcgacggcaaccacatgttcgccggtcacttaaagtgcaaggtcagaatggaaaaactgaggattaagggcatgagctacaccatgtgttccgggaagttcagcatcgacaaggagatggccgagacgcagcacggtaccaccgtggtgaaggtcaagtacgaaggaaccggggccccctgcaaggtaccaatagagatacgagacgtgaataaggagaaggtcgtggggagaataatctcctctacgccattcgccgagaacaccaactccgtgacaaacatcgagctcgagccgcccttcggggacagctatatcgtaatcggcgtgggggattccgcactgaccctgcactggttccggaagggaagtagcatcggcaaaatgttcgaaagcacgtaccgcggggctaagcggatggccatcttgggagagaccgcctgggattttggatccgttgggggattgctgaccagcttagggaaggcggtccaccaggtcttcggctccgtgtacactacgatgtttggcggcgtcagttggatggtgcgcatcctgatcgggctgcttgtgctgtggataggcaccaactcccggaataccagcatggccatgtcgtgcatcgccgtcggagggattaccctgtttctaggtttcacggtgcacgccgacatggggtgcgtggtctcctggagtggaaaggagctcaaatgcgggagcggcatattcgtgatcgacaacgtgcatacctggaccgagcagtacaaatttcagccggagtcgcccgcccggcttgcctccgcaatcctgaacgctcacaaggaaggtgtctgcgggatacggagcaccacgcgcctcgaaaacgtcatgtggaaacagatcaccaacgagctgaactacgtcttatgggaaggaggtcacgatctcaccgtcgtggccggcgacgtgaagggcgtactgtccaaggggaagcgggccctggcaccgcccgttaacgaccttaaatacagctggaagacgtggggcaaggccaagatcttcacccctgaaaccaggaactccaccttcctggtggacgggcccgataccagcgaatgcccgaacgagcgacgggcctggaacttcctggaggtcgaggactacggattcggtatgtttacaacgaacatctggatgaagttccgggagggctccagcgaggtgtgtgatcaccgcctcatgtctgcggcgatcaaggaccagaaggcggtacacgccgacatgggctattggattgagagctccaagaaccagacatggcagatcgagaaagcgagcttgatagaagtaaagacctgcctctggccgaagacacacacgctctggtcgaacggggttcttgagagccagatgctgatccccaaggcttatgcaggcccgatttcccaacacaactaccggcagggctacgccacccagacagcaggaccatggcatctcgggaagttagagatcgacttcggggagtgccccggtaccacggtaacaattcaggaggattgcgaccaccgcgggcccagcttacgaaccaccacggcctccggcaagctcgtcacgcaatggtgctgccggtcatgtaccatgccgcccttacgcttccttggggaggacggctgctggtacgggatggagatcagacccctcaatgagaaggaggagaacatggtcaaaagccaggtaagcgcgggccagggcacgagcgagacattttctatggggctgctgtgcctcaccctatttgtcgaagagtgcctgcgccgtcgcgtgacccggaagcatatgattctcgtcgtggtgaccacgctgtgcgcgatcatcttaggagggctcacctggatggatcttctaagggccctcataatgctgggcgacacaatgagcgggagaatgggaggccagatccacctggctatcatggctgtcttcaagatgtcccccgggtatgtgctaggcatcttcctgcgcaagctaaccagccgggaaacggcccttatggttattggcatggcgatgactaccgtgctgtccatccctcacgacttaatggaatttatcgacggcattagcctcggcttaatcctgctcaagatggtcacgcacttcgacaatacgcaggtagggacactggccctggccctcacgttcatcaagagtaccatgcctctggtcatggcctggcgcacgataatggccgtgttgttcgtggtaaccctcataccgctgtgccggacgtcctgcctacagaagcagtcacactgggtggaaatcactgctctcattcttggggcccaggcccttcccgtgtacctcatgacactcatgaagggggccagcaagcgctcctggccgctgaacgaaggcattatggctgtgggattggttagcttgctgggctccgccctgctcaagaatgacgtacccctggctggccccatggtcgccgggggtttactgctggccgcttacgtgatgagcggctcctcggccgatcttagcctggagaaagccgccaacgtccagtgggatgagatggccgacataacgggcagcagcccaatcatcgaggtcaaacaggacgaggacgggtccttcagcatccgggatgtggaggagaccaatatgatcactttactcgtgaaacttgcccttatcacggtttccgggctatacccgctcgccatccccgtcaccatgactctttggtacatgtggcaagtgaagacccagcgcagcggtgccctctgggacgtgccgagtcccgccgccgcccaaaaagccacgctgaccgaaggggtctataggatcatgcagcgaggcctgtttggtaagacacaagtgggagtcggtatccacacggaaggcgtgttccacaccatgtggcacgtgacgcggggctcagtcatctgccacgagtccgggaggttagagcctagctgggcggacgtgcgcaacgacatgatctcctacggcggaggctggcgcctgggagataaatgggacaaggaggaggacgtgcaggtcctggcaattgaaccggggaagaatcccaaacacgtacagaccaagcccggccttttcaaaaccctaacaggcgaaataggggctgttacgcttgatttcaaaccggggacaagcggctcccccattataaaccggaagggaaaggtgatcgggctctacggcaatggggtagtgacaaagtctggcgactacgtctccgcgatcactcaagcggaacgcatcggtgagcccgactacgaggtggacgaggacatctttcgcaaaaagcgtctgaccataatggacttacaccctggtgccggaaagaccaagcgcatcctgcccagtatcgtgcgggaggccttgaagcgcagactaagaacactgattctcgcccccacccgggtcgtagccgctgagatggaggaggcgctgcggggactaccaatacgataccagacgcctgcggtgaaatccgaacacactggcagggagatcgtagacctcatgtgtcatgccacttttactactaggctgttgagctccacccgtgtgcctaactacaacctcattgtgatggatgaagctcacttcaccgaccccagctccgtggccgccagagggtacatcagcacccgagtggagatgggcgaggccgcggctatcttcatgacggccacacccccagggactactgacccctttccccagagcaactcccccatcgaggacatagagcgggagataccggagagaagctggaacaccggctttgactggatcaccgactaccaaggaaagacggtttggttcgtgccctccattaaagcagggaacgacattgccaattgcttgagaaagagcggcaagaaggtgatccagctgagtcgcaagacctttgatacagagtacccgaagacaaaacttaccgactgggacttcgtcgtgaccacggacatatcagagatgggtgcgaacttccgggccggccgagtgatcgacccaaggcggtgcctcaaaccggtcattctaaccgacgggcctgaacgggtgatcctcgccggccccattccagtcacaccggcctccgctgcccagcggcgcggccgcatcgggcgcaacccagctcaggaggatgaccagtacgtgttcagtggagatccattgcggaacgacgaagaccacgcgcactggaccgaggccaagatgttactcgacaacatctacacacccgaagggatcatcccgactcttttcggcccggagcgcgagaagactcaggcgatcgacggcgagttccggctgcggggtgagcagcgcaaaaccttcgtggagctaatgcgccggggtgacctgcccgtgtggctgtcctacaaggtcgccagcgccggcatcagctacaaggaccgcgagtggtgctttactggagagcggaacaaccagatcctggaggagaacatggaagtggagatctggacccgcgagggagagaagaaaaagctaaggccgaagtggctggatgccagagtgtatgccgacccgatggcgctcaaagactttaaggagtttgccagcggtcggaagtccatcaccttggacatactgacggaaatcgcctctctcccgatgtacctatccagccgcgccaagctggcgttagacaatatcgtcatgctgcacacgacggagcgtggagggaaggcatatcagcacgccctgaacgagctccccgaatccctggagactctcatgctcgtcgccttgttaggcgccatgaccgctggtatttttctcttcttcatgcaaggaaaagggatcggtaagctgagcatgggcctgatagctatcgctgttgcctccgggctcctgtgggtcgccgagatacagcctcagtggatcgcagctagcatcatcctggagtttttcctcatggtgctgctggtccccgaacccgaaaaacagagaacaccccaggataaccaactcatctacgtaatcctgacgatactgactataatcgccctcgtagccgccaacgagatgggccttatcgaaaagacgaagacagacttcggtttctaccaggtgaaggcggaaactactatcctggacgtcgaccttcgcccggcgagcgcctggaccctgtacgccgtggcaacgacgatcctgacaccgatgctccggcacaccatagagaacacgtccgcgaacctgagcctagctgctatcgccaaccaggccgcggtccttatgggactggggaagggctggccgctgcaccgcatggatctcggggtacccctgctagccatgggctgttacagtcaggtgaacccgacgacgctcaccgcctctctagtgatgttactcgtccactacgcaatcatcggacccgggttacaagcgaaggctacacgggaggcacaaaaacgcaccgccgccgggataatgaagaaccccacggtggacggcataaccgtgattgacctggagcccatctcctatgatcccaagttcgagaagcagctcggtcaggtcatgctgctggtgctctgcgccggccaactgctactcatgaggaccacgtgggccttctgtgaggtcctgaccctggccacggggcccatcctcaccctatgggagggcaaccctgggcgcttctggaacacgacgatcgcggtctcgaccgctaacatttttcgaggctcctacctggcgggcgccggtctcgccttcagtctgatcaaaaacgcacagacgcccaggcggggtacggggaccactggcgaaaccctgggagagaagtggaagcgccagctcaactcccttgatagaaaggagttcgaggaatacaagcgctccggcatcctggaggtggaccggacggaggccaagtccgcgctcaaggatggttccaagatcaagtttgccgtaagtcgcggcactagcaagatccggtggatcgtcgagcgcgggatggtaaagccgaaggggaaggttgtcgacctgggttgcggcagaggcggctggtcgtactatatggctactctgaagaacgtgaccgaggtgaaggggtacaccaaaggcggacccggccacgaggagccggtccccatggccacgtacgggtggaacctcgtaaagttgcacagtggcgtagacgtcttctacaagcccaccgagcaggttgacaccctgctctgtgacattggcgagtcctcatccaaccccaccatcgaagaggggagaacgctcagagtgctgaaaatggtcgagccctggcttagcagcaagccggagttctgtatcaaggtgctcaacccgtacatgcccaccgtcatcgaggaattggaaaaactacagcgacgccacggtgggtccttggtccggtgccccctctcccgcaacagtacccacgagatgtactgggtcagcggagtctcggggaacatcgtgagctccgtgaataccacgtccaagatgttattaaacagattcacgactcgccaccgtaagccaacatacgagaaggacgcggatctgggggcgggcacgcgctccgtcagcactgagacagagaaaccggacatgaccatcattgggaggcgattgcagagactccaggaggagcacaaggagacgtggcactatgatcacgagaacccctatagaacttgggcatatcacggatcctacgaagcccccagcacaggttccgccagcagtatggtgaacggcgtggtgaaactgctgactaaaccgtgggacgtggtcccgatggtcacacagctcgcaatgaccgacaccacgcctttcgggcagcaacgcgtatttaaggagaaggtggatacgcgcacgccccagcccaagcccgggactagggtcattatgaccacgacggccaactggctttggacgctgctcggccgtaagaaaaacccgaggctatgtacccgagaggagttcataagtaaagtgcggtccaacgccgccatcggcgccgtttttcaggaggagcagggctggaccagtgcgtccgaagcagtcaacgacagccgtttctgggagttggttgacaaggagcgcgccctccaccaggagggaaaatgcgagagttgtgtttacaacatgatgggcaagcgcgagaaaaagctgggcgagttcggacgtgcgaagggttccagagccatctggtacatgtggctgggcgcgcggttcctcgagttcgaggccctggggtttctgaacgaggaccattggttcggccgggagaacagctggtctggagtcgagggcgagggactccaccgcttgggctatatcctggaggacatcgacaagaaagatggggacctcatttacgccgacgatacagcaggctgggataccagaatcactgaagacgatctgctgaatgaggagctcataacggaacaaatggcgccacaccacaagatcctagccaaggccatcttcaaactgacctaccagaacaaggtcgtgaaggtcctcagaccaaccccgaagggcgccgtgatggacatcatcagtcggaaggaccaacgcggatcaggccaggtggggacttacggtctgaataccttcacgaacatggaggtacagctgatcagacagatggaagctgaaggcgtgataacccaggacgacatgcacaatcccaagggcctcaaggagcgcgtcgagaagtggctcaaagagtgcggagtcgaccggctgaaacgcatggccataagcggcgacgactgcgtggtaaagcccttagatgagcggttctccacctctctgcttttcctcaacgacatggggaaagtgcggaaggacatcccccaatgggagccctcaaaaggttggaagaactggcaggaggtgcccttctgctcacaccatttccataaaatattcatgaaggacggccggtccctggtggtgccttgcagaaaccaggacgagcttatcgggcgggcaaggatcagccagggcgccggttggtccttgcgggagaccgcgtgccttggaaaggcctacgcgcagatgtggtcgttgatgtatttccaccggcgagatctccgtctcgctagcatggctatctgcagcgccgtcccgacggagtggttcccgacgtcccgcacaacctggagcattcatgcacatcaccagtggatgacgaccgaggacatgctgaaggtgtggaatcgggtctggatcgaggacaacccaaacatgatagacaaaaccccggtgcattcctgggaggacatcccgtatctgggcaaacgcgaggatctgtggtgcggctccctgatcggcctcagctcccgggccacgtgggcgaaaaatatccatactgccatcacccaggttcggaatctaatcgggaaggaggagtatgtcgactacatgcccgccatgcgtagatacagcgcccacttcgaaagtgagggcgtgctgtga

SEQ ID NO: 26222 - RNA, 9867 nt, synthetic construct
  misc_feature 1..9867: note = derived and/or modified CDS sequence (opt11) from DENV-4__KP188557__SS-prME
  source 1..9867: mol_type = other RNA
tccaccatcacgctgctgtgcctgatcccaacggtgatggctttccatctgagtacgcgcgacggtgaaccgctcatgatagtcgccaagcatgagcgcggtcgccccttactgttcaagaccaccgaaggaattaataagtgcactctcattgccatggatctgggggagatgtgcgaggataccgtgacctataagtgtcccctgctcgtgaatacggagccggaggacattgactgctggtgcaatctgacttccacctgggtcatgtacggaacctgtacgcagtccggggagaggcggcgggagaaaaggagtgtcgccctcacgccgcactcaggcatgggcctcgagacccgggcggagacctggatgagcagcgaaggggcatggaagcacgcccagagagtggagtcttggattttaagaaacccaggcttcgcgctactcgctgggtttatggcctacatgattggccagaccggcattcagagaactgtctttttcgtgctaatgatgctggtagcgcccagctacggcatgcggtgtgtgggcgttgggaaccgcgacttcgtagagggcgtcagtgggggcgcatgggtggatctggtactggagcacggcgggtgcgtcactacgatggcgcagggcaagccgaccctggactttgaactcactaaaaccaccgcgaaggaggtagccctgctgcggacttattgtatcgaagccctcatatccaacattacgaccgcgacccgttgcccgacccaaggggagccctacctgaaggaggaacaggaccagcagtacatatgccggcgagatgtggtagaccgcggctgggggaatgggtgcggcttattcgggaagggaggggtggtgacgtgcgcgaagttcagctgttccggcaaaatcacggggaacctcgtccagatagagaacctggaatacaccgtggtcgtcaccgtgcacaatggcgacacgcacgcggtcggtaacgacacaagtaatcacggtgtcaccgccaccattactccccgttcccccagcgtcgaggtcaaacttccagattacggagagctcaccctggactgcgagccacggtccggaatcgacttcaacgagatgatcctaatgaaaatgaagaagaagacctggctcgtgcacaagcagtggttcttggatctccccctcccctggacgacaggcgccgacacgtccgaggtgcactggaactacaaggagcgcatggttaccttcaaggtaccgcacgccaagcggcaggacgtgaccgtcctgggctcccaggagggcgccatgcacagcgcccttgccggggcaaccgaagttgactcaggggacggcaaccacatgttcgctggtcatctcaagtgcaaggtgcgcatggagaagctgcgcatcaaaggcatgtcgtacacgatgtgtagcggcaagttttccatcgacaaggaaatggccgaaacacagcacgggacgaccgtagtgaaagtgaagtacgagggggcgggggccccatgcaaggtccccattgagatccgcgatgtgaacaaagaaaaggtggtgggccgcgtgataagcgctacgcccctggcagagaacacaaactcagtaacgaacatcgagctcgagccgccgttcggggacagctacatcgtcatcggcgtgggtaactcggctcttacccttcactggttcagaaaagggtcatccatcggcaagatgtttgaaagcacgtaccgcggggctaagcggatggccatcctcggcgagaccgcgtgggacttcgggtccgtgggcgggctgttcacaagcctcgggaaggccgtgcaccaggtattcggtagcgtgtacaccactatgttcgggggcgtcagctggatgatccgcattttgataggctttcttgtcctgtggatcggcacaaactcccgtaacacctctatggccatgacctgtatcgctgttggcggtatcacactcttcctcggctttacagtgcaagcggacatggggtgtgtggtttcatggagcggtcgggagctgaagtgcggcagtggcatctttgtagtagacaacgtgcacacgtggacggagcaatacaagttccagcccgaaagccccgctcggttagctagtgctatactcaacgctcacaaggacggcgtatgtgggattcgcagtacaacccggctggagaacgtgatgtggaagcaaattactaatgagcttaactacgtgctctgggagggcgggcacgatctgaccgttgtcgcgggcgatgtaaagggcgtccttacgaagggtaagcgcgcgctcacgccgccagcgagcgacctgaaatactcctggaagacctggggcaaggcaagaattttcaccccggaggctaggaacaacacttttctgatcgacggtcccgacaccagcgagtgcccaaacgagcggcgcgcctggaactccttcgaggtggaggactacggtttcgggatgttcaccactaacatatggatgaagtttcgggagggcagctctgaggtttgcgaccaccgcctgatgagcgcggcaatcaaggaccagaaggccgtccacgccgatatggggtactggatcgagtccagcaagaaccagacgtggcagatagagagggcgtccctgatagaagtgaagacctgcttgtggcccaagactcacaccctctggagcaacggcgtcctggagtcccagatgctgatccccaaaagctacgcgggcccgttcagtcaacacaactatcgccaagggtacgccactcagacggtcggcccctggcatctggggaagctggagatcgacttcggggagtgccccgggacaaccgtgaccatccaggagaattgcgaccaccgcgggcccagcctgcgtactaccaccgcctccggcaaacttgttacccagtggtgttgtcgctcctgtacaatgccgcccctgcgcttcctgggggaggacggctgctggtacgggatggagattcgcccactcagcgagaaggaagaaaacatggtcaagtcccaggtcactgcgggtcagggcacctccgagaccttttccatggggctgctgtgcctgacgctgttcgtcgaggagtgcctacggaggcgggtgacccgcaagcacatgatcctcgcggtcgtcatcaccctgtgcgccatcatccttggcgggttgacgtggatggatctgctgcgggccctcatcatgctgggggacacgatgagcgggcgcatcgggggccagacccatctggccatcatggccgtgttcaagatgagtcccgggtatgttctgggtgtgttcttacgcaagctgacctcacgcgaaactgccctaatggtgatcgggatggccatgactaccaccttgagtattccacacgacctgatggagctcatcgacggcatcagcctgggcttgatcctcctgaaaatcgtgacccagttcgacaatacgcaagtcggaactctggccctctccctgaccttcatacggtcaactatgtcactggtgatggcatggcgtaccattatggcggtactcttcgttgtgaccctgatccccctgtgcagaacctcgtgcctccagaagcagtcccactgggttgaaatcacggcgctgatacttggcgcccaggccctcccggtctacttgatgactttaatgaagggggccagccgccggtcctggccgctcaacgaaggaatcatggcggttgggctggtttcgctgctcggctcagccctgctgaagaacgacgtcccgctcgccggccccatggtggccgggggattactactcgctgcgtacgtgatgagcggctccagcgccgacctgagcttagagaaggcagcaaacgtccgatgggacgagatggccgacattacggggtccagtcccattatcgaggtgaagcaggacgaggatgggagtttctcgatccgggacgtagaggagaccaacatgatcaccctcttggtcaagctggcgttgatcacggtgtccggcttgtaccccctggccatcccgatcactatgacactctggtatatgtggcaagtgaagacccagcggtcaggcgccctgtgggacgtcccaagccccgccgcgacccagaaggcggccctgagcgaaggtgtgtaccggatcatgcagcgcgggttatttgggaaaacacaagtgggcgtcgggatccacatggagggcgtgttccacaccatgtggcacgtgacccgcggctcagtcatctgtcacgagaccgggagactggagcccagctgggccgacgttcgcaacgacatgatctcctacggcggtgggtggcggctgggagataagtgggacaaggaggaagacgtgcaagtactcgccatcgaacccgggaagaaccccaaacacgtacagaccaagcccggtctgttcaagacccttacgggggagatcggtgccgtcacgctcgattttaagcccggtacctcaggctccccgataatcaaccgcaaaggcaaggtcatcgggctctacgggaatggggtggtgaccaaaagcggcgactacgtctccgcgataacgcaggccgagcggataggggagccagattacgaggtggatgaagacatctttcgcaagaagagactgactatcatggatctgcaccccggcgcaggtaaaacgaagcgcatcctgccgagcatcgtgcgagaagccctgaagcgacggctgcgcaccctcatcctggccccgaccagagtcgtggccgccgagatggaggaagccctccgcgggctccccatccgataccagacgcccgccgtgaagtccgagcacactggccgcgagattgtcgacctgatgtgccatgcaactttcaccacccggctgttaagcagcacgagggtcccgaattacaacctgatcgtgatggacgaggcccacttcacagaccctagcagtgtggccgcccgggggtacatctccacccgcgtggagatgggcgaggccgcagccatttttatgaccgctacaccgcccggcgccactgacccgtttccgcagagtaactccccgatcgaggacatcgagcgcgagatcccggagcggagctggaacaccggcttcgactggatcacggactaccagggcaagacggtctggttcgtcccgtccatcaaagccgggaatgacatcgcgaactgcctgcgcaagtccggtaagaaagtgattcaactctcccggaagacattcgacacggagtaccccaaaacaaagctgacggactgggatttcgtcgtcacgaccgacatctctgaaatgggagccaacttccgcgcgggtcgggtgatagaccctcgccggtgcctgaagcccgtcatcctcaccgacgccccggagcgcgtgattctagcggggcctatccccgtaacacccgcctccgcggcccagcggcggggacggatcggccgcaaccccgcacaggaggacgaccagtacgtgttcagcggggaccccctgaaaaacgacgaggaccatgctcactggaccgaggcgaagatgctgctggacaacatctatacaccagagggtattatccccactctgttcggcccggaacgggagaagacacaggccatcgacggcgagttccgcttgcgaggggagcagcgcaagacattcgtggagctcatgaggcgtggggacctgcccgtgtggctctcctacaaagtcgcctcagccgggatctcctataaggatcgggagtggtgcttcaccggtgagagaaataaccagatcctggaagagaatatggaggttgagatctggacgcgggagggggagaagaagaagttaaggcccaagtggttggacgctcgggtgtacgccgaccccatggccttaaaagacttcaaggagtttgcctcgggcagaaagtctatcaccttagatatactcacggagatcgccagcctgccgacctacctgagcagtagagcgaaattagcccttgacaacatcgtgatgctgcataccacggagcggggcggcagggcctaccagcatgcactcaacgaactgcccgagtccctcgagacgctcatgcttgtggcactgctcggggccatgaccgccggaatattcctgttcttcatgcagggaaaggggatcgggaaacttagtatgggcctcatcaccatcgcagtggcaagcggcctgctgtgggtagcggaaattcaaccccagtggatcgccgcctccatcatcctcgagttcttcctgatggtgctcctcatccccgagcccgaaaagcagcggacaccccaggacaaccagctgatctatgtgatcctgacgatcctcacaataattggattgatcgccgccaacgagatggggctgattgagaagaccaagaccgactttgggttctatcaggtcaagaccgagactaccatcctcgacgtcgacctaagacccgcttccgcgtggacgctctatgcagtggccacaaccatcttaaccccgatgctgcggcacactatcgaaaacacgagcgccaacctctcactcgcggccatagcaaaccaggcggccgtcctgatgggcttgggcaagggatggccccttcaccgcatggaccttggcgtccccctgctcgcgatggggtgctactcccaggtcaatcctactaccctcacagcctcgctggtcatgctcctggtacactacgcgatcattggcccgggtctgcaggccaaagcgacgcgggaggcccagaagcgcactgctgcgggtatcatgaagaacccaaccgttgacggcataaccgtaatcgatttagagcccatctcctacgaccccaagttcgaaaagcagctggggcaggttatgcttctcgtgctgtgcgccgggcagctactgttaatgagaacgacctgggcgttctgcgaggtcttaaccctcgcgaccgggccgatccttacgttgtgggagggcaaccccgggcgcttctggaacacgaccatcgccgtgagcaccgccaatatattccggggttcctatctcgccggagcgggcctggccttctcgctgatcaaaaacgcccaaacgcctcgacggggcaccggaaccgccggcgaaacgctcggggagaagtggaagcgccagctgaactccctagaccggaaggagttcgaggagtataaacgcagcggcatcctcgaggtggaccggacagaagccaagtccgcattgaaggacggctcgaagatcaagcacgccgtctcccgcggcagctccaaaattaggtggatcgtggagcggggcatggtaaagcccaagggcaaggtcgttgacctgggatgcggacgcggcggttggtcctattacatggccacgttgaaaaacgtaaccgaggttaaggggtacacgaagggcgggcccgggcacgaagaacccatcccgatggccacctatggatggaacctagtgaagctgcacagtggtgtagatgtcttctacaagcccacggagcaagtggacaccctcctgtgcgatataggagagagcagctccaaccctactatcgaggaagggcggaccctccgagttctcaagatggtcgagccctggctcagctccaagcccgagttttgtataaaggtccttaacccatacatgccgacggtgatcgaggagttagaaaaacttcaacggaaacacggtgggaacctagtccgctgtcccctgagccggaacagtacccacgagatgtactgggtgagcggcgcgtcgggcaacatcgttagctccgtgaacaccactagcaagatgctcttaaacagattcacgactcggcatcgcaagccgacatacgaaaaagacgtggacctgggcgccggtactcggtccgtctcgacggagaccgagaaacccgacatgacaataatcgggcgccggctccagcgcctccaggaggagcacaaagaaacctggcactatgaccaggagaacccgtaccgaacgtgggcctaccacggctcttacgaggcccccagtaccgggtctgctagctccatggtgaacggcgtggtcaagctgctcaccaagccatgggatgtgatcccgatggtgacacaactagcgatgacggacaccaccccattcggccagcaacgcgtcttcaaggagaaagtggatacccggacaccacagccaaagccgggaacccgaatggtgatgaccaccacggctaactggctgtgggcgctactaggcaaaaagaagaacccccggttatgcacccgcgaagagttcatcagcaaagtccggtccaatgctgccatcggagcggttttccaggaggagcagggctggactagcgccagcgaggccgtcaatgacagccgcttttgggagctcgttgacaaggagcgcgccctgcaccaggagggaaagtgcgagagctgcgtgtacaacatgatgggcaagcgggagaaaaagctgggcgagttcgggcgcgccaagggctcccgggcgatctggtacatgtggctcggggctcggttcctggaatttgaggctctgggtttcctcaacgaggaccactggtttggacgggagaacagctggtcgggcgtggagggcgaagggctacaccgtctgggctacatactcgaggagatcgacaaaaaggacggtgacttgatgtacgccgacgatacagcgggatgggacacccggatcactgaagacgacctgcagaacgaggagctcatcacggaacagatggctccccaccataagatcctggccaaagccatcttcaagctaacttaccagaataaggtcgtgaaggtactccgccccaccccgcgcggcgccgtcatggacatcatcagccgcaaagaccaacgggggtccggccaggtgggcacgtacggcctaaacaccttcactaacatggaagtgcagttaatccgccagatggaggcggaaggggtgatcacccaggatgacatgcagaatcccaagggtctcaaggaacgggtggagaaatggctgcgcgagtgcggagtggatcgcttaaagcgcatggccatttcaggggacgactgcgtcgtgaagccgctcgacgagcggtttggcacgtccctccttttcctcaacgacatggggaaggtgcgcaaggacattccgcagtgggaaccgagcaagggctggaagaactggcaagaagtcccattctgttcccaccactttcacaagatcttcatgaaggacgggcggagcctggtggtaccttgccgaaaccaggacgaactgatcggccgcgcccggatctcccagggcgcggggtggagcttgcgcgagaccgcctgcctgggcaaggcgtacgcccagatgtggtccctgatgtatttccaccggagagaccttcgtctagccagcatggcgatctgctccgcagtccctaccgagtggtttccgaccagccgcaccacctggtcaatccacgcgcaccaccagtggatgaccaccgaggatatgctgaaggtgtggaaccgggtgtggatcgaggataaccctaacatgatcgacaagacgcccgttcacagttgggaagacatcccgtatctcggcaagcgcgaggatctgtggtgcggcagcttgatagggctcagctctcgggcaacatgggccaagaacatccataccgccatcacccaggtgcggaatctgatcggcaaggaagaatatgtggattacatgccggtcatgaaacggtactccgcaccgagcgaatccgagggcgtgctataa

SEQ ID NO: 26223 - RNA, 9867 nt, synthetic construct
  misc_feature 1..9867: note = derived and/or modified CDS sequence (opt11) from DENV-4__KP188558__SS-prME
  source 1..9867: mol_type = other RNA
tcaacaatcacactactatgtctaataccaaccgtcatggcttttcacctatccacaagggacggcgaacccttgatgatagtagcaaaacatgaacgtggccgcccgctcttattcaaaactacggaaggcatcaacaaatgcaccctcatagcgatggacctaggcgaaatgtgcgaagacacggtgacctataagtgccccctcctagtcaacacagaaccagaagacatagactgctggtgcaacctgacgtcgacatgggtgatgtacggtacttgcacacagtctggggaacggcgccgggagaaaaggagtgtagcactaacaccacactcgggaatgggactcgaaactcgggccgaaacttggatgagcagcgaaggggcatggaagcacgctcaaagagtagaatcctggatcctcaggaacccggggtttgctctgttagcggggtttatggcatacatgataggacagacgggaatccaaaggacggtcttctttgtactaatgatgctcgtggcgccaagctacggaatgcgctgtgtgggggtgggcaaccgcgatttcgttgagggggtgtccggcggagcctgggtagacctagtgttggaacacgggggatgcgtcacgacgatggcacaaggaaaaccaacactcgacttcgaactcacaaaaacaacggctaaagaggtcgcgctgttgcggacgtactgcatagaagcactaatatctaacatcacgacagcaacacgctgccctactcaaggcgaaccctacctgaaggaagaacaggatcaacagtacatttgccgcagggacgtggtggatcggggctggggaaacggatgcggcctcttcggaaagggaggcgtcgtaacctgcgcaaaattcagttgttccggaaagataacagggaacctggttcaaatcgaaaacctcgaatacacagttgtcgtcaccgtgcatgacggagacacccacgcggtcggcaacgacacctccaatcacggagtaacagcaacaataaccccgcggtcccccagcgtagaggtgaaactaccggattacggcgaactcacactggattgtgaaccacgctcggggatagactttaacgaaatgatactaatgaaaatgaaaaagaagacctggctcgtccataaacaatggttcctggacctaccattaccctggacaaccggggccgatacctccgaagtgcattggaattacaaggaaagaatggtaacctttaaggtcccgcacgcgaaacgccaggacgtcacagtgctaggaagccaggagggcgcgatgcattccgctcttgctggagccacagaggtagacagcggagacgggaaccatatgttcgccggacacctcaaatgcaaggtacgcatggaaaaactaagaataaaaggcatgagttacacaatgtgtagcgggaaattcagcatagacaaagagatggctgagactcagcatggaaccacagtggtaaaggtgaaatacgagggggcgggtgcaccatgtaaagtcccgatagaaattcgggatgtgaacaaagagaaggtcgtaggtcgggtgatatccgcaacaccactggccgagaacacaaatagcgtcaccaatatcgagctggaacccccattcggagactcgtatatcgtaatcggagtcggcaactcggccctcacactacactggttccgcaagggcagcagcatcggcaaaatgtttgagagtacctaccgcggggccaagagaatggcgatcctaggtgaaaccgcatgggactttggctcagtcggaggcctcttcacatccctgggcaaagccgtgcatcaagtgtttgggagcgtttacacaacgatgtttggaggagtctcatggatgatccgcatactcatagggttcttagtcttatggataggcacgaactcgcgtaacacaagcatggctatgacgtgcatcgccgtcggaggaatcacactatttctcggatttacggtgcaagcggacatggggtgcgtagtttcatggagcggccgtgaactgaagtgtggctcgggcatattcgtagtggacaacgttcatacgtggacagaacagtacaaattccaacccgagtcaccagcacgtctcgcaagcgccatactcaacgcccacaaggacggtgtatgcggtatccgtagcacgacccgtcttgaaaacgtaatgtggaagcaaataacaaacgagcttaactacgtactctgggagggaggtcacgatttgaccgtagtagctggcgacgtaaagggcgtcctgacaaaggggaaacgcgctttaacaccaccggcgagtgacctgaagtactcatggaaaacctggggaaaagcgaagatcttcacgcccgaagcaagaaattccacattcttaatcgacgggccagacacatccgaatgcccgaacgaaagaagggcctggaactcattcgaagtggaggactatgggtttgggatgttcacaacgaacatatggatgaagtttagagaaggaagcagcgaagtgtgcgatcaccgcctcatgtccgcagccattaaagaccaaaaagcggtgcacgccgacatgggatactggatcgagtcctccaagaatcaaacgtggcagatcgagagggcgtcattaatcgaggtaaagacatgcttgtggcctaagacacatacactctggagcaatggggttttggaatcgcaaatgttgatccccaaatcatacgctggaccatttagccagcataactaccgccagggatatgcaacgcagaccgtcggaccgtggcacttgggaaaattggagatcgacttcggtgaatgtccaggcaccaccgtaaccattcaagaaaactgtgatcacagggggccgagcctgcgcacgacgaccgcatctggtaagctggttacacaatggtgctgcagatcatgcacgatgccaccgctgaggttccttggagaagatgggtgttggtacggaatggaaatccgccccctatcagaaaaggaggagaatatggtgaagagtcaggtcaccgcagggcaggggacctccgagaccttttccatgggactgctgtgcctgaccctctttgtggaggaatgtctacgcagacgcgtgacgcgcaagcacatgatcctcgcagtcgtaataacactatgcgcaatcatcctgggaggccttacatggatggacctacttcgcgccttgataatgttgggagacacaatgagcgggcgcatcggcggtcaaactcacctcgcgatcatggctgttttcaaaatgtcgcccgggtacgtactcggggtcttcctgaggaaattgaccagccgcgaaactgcactcatggtgataggcatggccatgacaaccacactatccataccccacgacctaatggagttgatcgacggaatatctttaggcctgattttgctcaagatagtgacacaattcgataacactcaagtcggcacccttgccctcagtctgacctttatacggagcactatcagccttgtaatggcatggcgaacgataatggctgtactattcgtcgtaacgctgatccccctgtgtcgaacgtcatgcctccaaaaacagagccactgggtggagataacagcgctcatactcggggcacaagcactgcccgtgtacttaatgaccctaatgaaaggtgcaagccggcgtagctggccactaaatgaaggaattatggccgtaggactggtcagcctcctcggcagcgcgctactcaaaaatgacgtcccgttggctgggcctatggtcgcagggggtctattgctagctgcatacgtcatgtccggtagtagcgcggatctctcgctcgaaaaagcagccaatgtgcagtgggatgaaatggccgacatcacgggctcgagtccaatcatagaggtgaagcaggatgaggacgggtcgttctcaatcagagacgttgaggaaaccaacatgataacactcctagtcaagttagccttaataacagtcagcggcctctacccgctggctatacccataacaatgacactatggtacatgtggcaggtcaagacacaacgaagcggcgcactctgggacgtgccatcgcccgccgccacgcagaaggccgctctatccgagggagtataccggataatgcagcgaggactattcggcaagacacaagtcggcgtaggtattcacatggaaggagtgttccacaccatgtggcacgtcacacggggatcagttatatgccacgagacaggccggttagagccatcgtgggctgacgtgagaaacgatatgattagctatgggggaggatggcggctcggcgataaatgggacaaagaagaagacgtacaggtacttgcaattgaaccagggaagaaccccaagcatgtacaaacgaaaccaggcttgtttaagacattaaccggggagataggggccgtcacactagattttaaacctggtacatctggctccccaataataaaccgcaaaggaaaagtaataggtctatatggcaacggcgtggtgacgaaatctggtgactacgtaagcgcaatcacacaggcagaacggataggcgaaccagactatgaggtggatgaggacattttccgcaagaagcgacttaccatcatggacctccaccccggggcgggcaagactaagcggatcttaccttccatagtgcgcgaggcactcaagcgacgactcagaaccctgatactcgcaccgacgcgcgtggtagctgcggagatggaggaggcactccggggactaccgataaggtatcagacaccagccgtcaagagcgagcacacaggacgcgaaatagtagacttaatgtgccatgcaacattcacgacgagacttctgtcgagtacccgagtaccaaactacaacctaattgtcatggacgaagcccactttacggatccgtcgtcagtcgccgcacgcggatacatatccacgagggtagaaatgggtgaagccgccgcgatcttcatgactgccacgcccccgggagcaactgatccgttcccccaatctaacagccccatagaggacatagagcgagagataccggagcgcagttggaacaccggtttcgactggataacagactaccagggtaagacagtatggttcgtgccgtccataaaagcaggcaacgacatcgctaactgcctgcgaaagtcaggcaagaaagttatacaattaagccggaaaacgtttgacaccgagtatccgaagaccaagctaactgactgggatttcgtagtaacgaccgacatctcagaaatgggtgccaacttcagggcaggaagggtaatagacccaaggcggtgcttaaagccagtaatactcacggacggccctgaacgggtaattctagcggggccaatccccgtgacaccagccagcgcagcgcagagacgtggccgaataggcagaaacccagctcaagaggacgaccaatacgtgttcagcggagacccactcaaaaacgacgaagaccatgcgcactggaccgaggccaagatgctgctagacaacatctacacccccgaaggaataataccgacgctgtttggccccgaaagagaaaagactcaagccatcgacggcgagttcaggctgcgaggtgaacagcgaaaaacgtttgtggagctaatgcggagaggggacctacccgtatggttatcatacaaagttgcatcagccggcatttcttacaaagaccgcgaatggtgcttcaccggtgaaagaaacaatcaaattcttgaagaaaacatggaggtagaaatatggaccagagaaggcgagaaaaagaaattacgaccgaagtggctcgacgcccgcgtgtatgcagaccccatggcactaaaagacttcaaggagttcgcgagcggcagaaagtcgattaccttggacatattaaccgagattgcatctctgcccacctatctaagtagccgcgccaaacttgccctcgataacatagtcatgctgcacaccaccgagaggggcggcagagcatatcaacacgccctgaacgagctgccggaatcgttagaaacgctgatgctcgtcgctctactgggagcgatgaccgccggcatcttcctattcttcatgcaaggaaagggcatcggcaaacttagcatgggactaataactatcgcagttgcctcaggtctcctctgggtagctgaaatccagccccaatggattgcagcctcaatcatcctagagttcttcctgatggtattgttaatcccggaaccggagaagcagcgcacaccccaagacaatcagctgatatacgtcatacttacgatcctaacaatcattggactcatagccgcaaatgagatggggttaatcgagaagacgaagaccgattttggtttttaccaagtcaaaacagaaacgaccatactcgacgtcgacctgagacccgctagcgcctggaccttgtacgcggttgccaccaccatcctaacaccgatgctacggcatacaatcgagaatacgtccgccaacctctcacttgccgccatcgctaaccaagccgctgtgctgatggggttaggaaaagggtggccactacaccgaatggacctaggagtcccacttctcgcaatgggctgctacagccaagtcaacccaaccaccttgacggcgagcctcgtgatgctgctagtacactacgccatcatcggccctgggctgcaagcaaaagccaccagagaagcacaaaaacgcacagcagcaggaattatgaagaatcccacggtcgacggcataaccgtgatagacctagaacccatctcctacgatcccaaattcgagaaacaactcggccaagttatgctcctcgtcctatgtgccgggcaattactactgatgcgtacgacctgggcattttgcgaagtattaacacttgcaacaggacctatactcacgctctgggaagggaacccgggtagattctggaatacgactatcgccgtttccacagcgaacatattccgtggttcctacctagccggtgcaggactcgcgttctcactaatcaagaacgcgcaaacaccccgacgaggaaccgggaccgcgggcgaaactctaggtgagaaatggaaaaggcaacttaactcccttgacagaaaggaatttgaagagtacaaaaggagcggaatcctagaagtagatcgcactgaagcaaagagcgccctaaaagacggaagcaagataaaacacgccgtaagccgcggcagctcgaaaattcgctggatagttgaacgaggaatggtcaaaccgaagggaaaggtggtagacctcggatgcgggagaggaggatggagctattatatggcaacccttaaaaatgtcacggaggtaaagggttacaccaaaggcggacctggacatgaggagcctattcccatggccacttacggatggaacctggtcaagctacactccggagtcgacgtcttttacaaaccaacggaacaagttgacacacttctgtgcgatataggggagagcagctccaatccgaccattgaggaggggcggaccctacgggtcctaaagatggtagaaccttggctctcaagcaaaccagagttttgcatcaaggtgttaaatccttacatgccaacggtaatcgaagaactagagaaactacaaagaaaacacggaggaaacctcgtccgatgccccctttcacgaaatagcacccacgaaatgtattgggtcagcggcgcgtcgggaaacatcgtaagctcggtgaatacaacgagcaaaatgctcctcaacagattcaccaccagacaccggaagccaacctacgagaaagatgtcgacctcggcgcaggaacgcgatcggtctccacagaaacggaaaagcctgacatgacaataatcggccggagattacagcggctacaggaagaacataaagagacctggcactatgaccaggaaaacccgtaccgaacttgggcataccacgggtcttacgaagcaccctccacaggaagcgcatcgtcgatggtaaacggagttgtcaagttgctaacaaaaccatgggacgtaatcccgatggtgacgcaacttgcgatgactgataccacgcccttcggacagcagcgagtattcaaggaaaaggtagatactcgcactccgcaacctaagccaggtactaggatggtcatgacaaccactgcgaattggctatgggcgctcctcggcaaaaagaaaaacccaagactttgcacaagagaagagttcatatcaaaggtacgaagcaatgctgccatcggcgcagtattccaagaagaacaaggatggacctctgcctccgaagcagtaaacgacagtcggttctgggagctcgtagacaaagaacgcgctttacatcaggaaggcaaatgcgaatcgtgcgtatacaatatgatgggaaaaagagagaaaaagctaggcgagttcggtcgggcgaaaggaagtcgcgctatttggtatatgtggttaggagcccgatttctcgagttcgaagctcttggatttttaaacgaagatcattggtttgggcgggagaacagttggtcaggagtcgaaggggagggcctccatcgactcggctacatactagaagaaatagacaagaaagacggcgacctgatgtacgcggacgacacagccggctgggacacgcgaataaccgaagacgacctccaaaacgaagaactaatcacagaacaaatggcacctcaccacaagatattagccaaggcaatattcaaactaacgtaccagaataaagttgtcaaggtcctacgccctacaccaagaggcgcggtcatggacattataagtcggaaagatcaacgggggagcggacaggtggggacttacggcttaaacacattcacgaacatggaggtgcagctaattagacaaatggaagcagagggcgtaatcacccaagacgacatgcagaatcccaaaggattaaaggagcgcgtagagaagtggcttcgagaatgcggggttgacaggttaaagcgaatggccataagtggggacgactgcgtggtcaagcccctcgatgaacgatttggcaccagcttactgtttctaaatgacatgggcaaagtccgcaaagacataccacaatgggaaccaagcaagggatggaaaaactggcaagaggtcccattttgttcgcatcacttccacaagatatttatgaaggacgggcgatcacttgtggtaccgtgcagaaaccaagacgagctgataggacgagcccgcatcagccaaggagccgggtggtcactgcgcgaaaccgcctgtctcggcaaagcctacgcgcaaatgtggagtctgatgtactttcacagaagggatctcaggctcgccagcatggccatctgctccgcggtccctacggagtggttcccaacctcccgcacaacttggtcaatacatgcccaccatcagtggatgaccacagaagacatgctcaaggtgtggaaccgggtgtggatagaagacaaccccaatatgatagataaaaccccggtacactcatgggaggacattccgtacctgggcaaacgcgaagacctgtggtgcgggtcgctgattggactgtcaagcagagcgacatgggcgaagaacattcacacggccataacccaagtaagaaaccttatcgggaaggaagaatacgtagactatatgccagtgatgaaacgctactccgccccgtcggaatcggaaggcgtcctataa

SEQ ID NO: 26224 - RNA, 9867 nt, synthetic construct
  misc_feature 1..9867: note = derived and/or modified CDS sequence (opt11) from DENV-4__KP188563__SS-prME
  source 1..9867: mol_type = other RNA
agcaccatcaccttactttgcctgatcccaacggtgatggccttccatctgtctacccgcgacggcgaaccgctcatgatcgtcgctaagcacgaacgggggcgcccgcttctgttcaagacgaccgagggcattaacaagtgcaccctgattgcgatggacctaggagagatgtgcgaggacacagtgacctataagtgccccctcctcgttaacacagagcctgaagacattgactgctggtgcaacctcacgagcacctgggtcatgtacggcacctgcacacagtccggtgagcggcgccgtgagaaaaggagcgtggctctgacaccccactccggcatgggtctcgagacccgggcagagacatggatgagcagtgaaggagcctggaaacacgcccagcgcgtggagagctggatcctgcgaaaccccggcttcgccctactggcgggtttcatggcctacatgatcggtcagaccggcatccagcggacggtcttcttcgtgctgatgatgctggtggccccctcctacggtatgcggtgcgttggcgttgggaaccgcgactttgtagaaggcgtcagcgggggcgcgtgggtggatctggtcctggagcacggtgggtgcgtcactaccatggcccagggcaagcccaccctggatttcgagttgactaagacgaccgcaaaagaggtggcgctgctgcgtacctactgtatcgaggcactgatatccaacatcacaacagctacccgctgcccaacccagggggaaccctatctgaaggaggagcaggaccagcagtatatttgccggcgcgacgtggtcgaccgggggtgggggaacggctgcggcctgttcgggaagggcggagttgtgacgtgcgccaagttcagctgctccggcaagattaccgggaacctagtccaaattgagaatctcgagtacacagtggttgttactgtgcataacggcgacacacacgctgtcggcaacgacacgtcaaaccacggggtaaccgccacaatcacgccccgctcgccaagcgtggaggttaaactgcctgactacggggagttaacgttagactgcgagccacggtcgggaattgactttaacgagatgatactgatgaagatgaagaaaaagacatggctcgtgcacaagcagtggtttctggacctgccgctcccctggaccaccggcgccgacacgagcgaagtgcactggaactataaggagagaatggtcaccttcaaggtgccccatgcgaaacggcaggacgttaccgtgctggggtcccaagagggtgccatgcactccgcactagccggggcgaccgaggttgactccggcgacggcaaccacatgttcgcgggacacctcaagtgcaaggtgcggatggagaagctccgcatcaaaggtatgtcctacacgatgtgcagcggcaagttctctatcgacaaagaaatggccgagacccagcacggaactaccgtcgtgaaggtgaagtacgaaggcgcgggagcaccgtgtaaggtccccatcgagatacgggacgttaacaaagagaaggtggttgggcgagtgatctccgccacgcccctggcagagaacaccaactctgtgaccaacattgagctcgaaccgcccttcggggacagctacatcgtaatcggcgtcggcaactccgccctcaccctgcactggttccggaaggggtcatccataggcaaaatgttcgagagcacgtacagaggggcgaaaaggatggccattctgggcgagacagcctgggacttcgggtccgttggcggcctgtttaccagccttgggaaagccgtccatcaggtattcggctccgtatacaccaccatgttcgggggtgtctcgtggatgatcaggatccttatcgggttcctggtgctatggattggaaccaactcccggaatacgtcgatggccatgacatgcatcgccgtcggaggaataacgctgttcctcggcttcaccgtccaagccgacatggggtgtgtggtgtcctggtcgggccgcgagttaaagtgcgggagcgggattttcgtcgtggacaacgtacatacctggaccgagcagtacaagttccagccggagagcccagcgcggctcgcgagcgctattcttaacgctcacaaggacggagtttgcgggatccgctccacgactcggctggagaacgtgatgtggaagcagatcaccaacgagctgaactacgtgctatgggagggagggcacgatctgacagtagtggccggcgacgtgaagggagtcctgacgaaggggaagcgcgcgttgacgccacccgcctcggatctgaagtactcatggaaaacctggggcaaggccaagatcttcacccccgaggcgcggaattctacgttcctcattgatgggccagatacgtccgagtgtcctaatgagagacgggcctggaacagctttgaagtcgaagactatgggttcgggatgttcacgaccaacatctggatgaagttccgcgagggcagcagcgaggtatgcgatcaccggctcatgtccgccgccatcaaggatcagaaggcggtccatgccgacatgggctactggatcgagagcagtaagaaccagacgtggcagatcgagcgcgcgagcctcatcgaggtgaagacctgtctgtggcctaagacgcacaccctctggtcaaacggggtgctggagtctcagatgctgatcccaaaatcatatgccggcccgttctctcaacacaactaccggcagggttacgccacccaaacggtcgggccctggcacctcggtaagttagagatagacttcggggaatgcccgggaaccactgtgactatacaagagaactgcgaccaccgcggtccgtccctgcgcacgactacggcctctgggaagctcgtgacccagtggtgctgccgatcctgcacgatgccgccgctccgcttcctgggggaagacggctgctggtacgggatggagatccggcccctcagcgagaaagaagaaaacatggtgaaaagccaggtgactgccgggcagggcacctccgaaaccttctcaatggggctgctctgcttgacgttatttgtcgaggagtgcttgcgacggagggttacccggaagcacatgatcctagcggtagttatcaccctgtgcgccatcattcttggcgggctgacctggatggacctgctgcgcgccctcatcatgctgggcgacaccatgtcgggccggatcggaggccaaacccacctggcaatcatcgctgtcttcaagatgtcgccggggtacgtcctcggcgttttcctgcgcaagctgacctcacgcgagacagcgctaatggttatcgggatggccatgacaaccacccttagcatcccacatgacctgatggaactcatcgacggcatcagtcttgggttgatcctcttgaagatcgtgacccagttcgacaacacgcaggtcgggacactagcgctcagcctgaccttcatccgctcgacgatgagcctggtgatggcctggcggacgataatggctgtgctcttcgtcgtaaccttgatcccactttgccgcacctcctgcctccagaagcagagccactgggtggaaatcaccgcccttatcctgggcgcccaggcccttcccgtctacctgatgacgctgatgaagggggcttcccgacgcagctggcccctcaacgagggcatcatggcggtggggctcgtgtccttactcggcagcgctttactgaagaacgacgtcccgttggccggccccatggtggcagggggcctgttgctcgccgcgtatgtgatgagcgggagcagcgccgacttatctctagagaaggccgccaatgtccagtgggacgaaatggcggacatcaccggcagctcccctatcatcgaagtgaagcaagacgaggacgggagcttctccatccgggacgttgaggagaccaacatgatcaccctcctggtcaagctggcgctcatcacggtgtcaggactgtaccctctggccatcccgatcaccatgaccctctggtacatgtggcaggtgaagacccagcgatctggcgctctatgggacgttccctcgcctgcggctacccaaaaagcggcattgtccgaaggcgtgtaccggatcatgcagcgcggattatttgggaagacgcaggtgggtgtcgggatccacatggaaggggtgttccacacaatgtggcatgtcacccggggtagcgtcatctgccatgaaaccggccgcctggagccctcatgggctgacgtcaggaacgatatgatcagctacggtgggggctggcggctgggcgacaaatgggaccgtgaggaggacgttcaggtcctcgccatcgagccggggaagaaccccaaacatgtccagacgaaaccgggcctgttcaagaccctgaccggggagataggcgccgttacactcgacttcaaacccggaacgtccggctcccccatcattaacaggaagggtaaagtcatcgggctgtacggcaacggggtagtgaccaagagcggcgattacgtcagcgccatcacccaagccgagcgaatcggggagcccgactacgaagtagacgaagatatcttccggaagaaacgcctgacaatcatggacctccatcccggagctggcaagacgaagcggatcctgccttccatagtgcgcgaggcactgaagcggcgtctgcggaccctcatcctggcgcctacccgcgtcgtggccgcggagatggaggaggcattgcgggggctccctatacgctaccagaccccagccgttaaaagcgagcacacgggccgagagatagtcgacctgatgtgccacgcgaccttcacgacccgccttctctccagcacgagagtgccgaactacaacctgatcgtaatggacgaggcccacttcaccgaccccagctctgttgcagcccgcgggtacatcagtaccagggtggagatgggggaagccgcggccatcttcatgactgccacgcccccaggggccaccgacccgttcccccagagtaacagcccaatcgaggatattgagcgagagatccccgaacgcagttggaacacgggcttcgactggatcaccgactaccaaggcaagacggtctggtttgtacccagcatcaaagcagggaacgacatcgcgaactgcctgcggaaatccggaaagaaagtgatccaactatcccgtaagactttcgacaccgagtaccccaagaccaagctgacggactgggatttcgttgtgacgaccgacatatcagagatgggggctaactttcgcgccgggcgcgtgatcgacccccggcgctgcctgaagcccgtcattctcaccgacgggccggagagagtgatcctagccggccccatacccgttactcccgcctcagcggcgcagcgccggggccgcattggccggaaccccgcccaggaggatgaccagtacgtcttctccggcgaccccctgaagaacgacgaggaccacgcacactggaccgaagctaagatgctccttgacaacatctacaccccggaaggcatcatccccacgctgtttggaccagaacgcgagaagacgcaggccatcgacggcgagttccggctccgtggagagcagcggaagaccttcgtggagctgatgcgccggggcgacctgccggtgtggctcagctacaaagtcgcatccgccgggataagttacaaggaccgggagtggtgtttcacgggcgagcggaataaccagatattggaggagaacatggaagtagagatctggacccgcgagggggagaaaaaaaagctgcggcctaagtggctcgacgcccgcgtgtacgccgatcccatggccctgaaggatttcaaggagttcgcctcagggaggaagagcatcaccctggacatcctcacagagatcgcctccctgccgacctacctgtctagtcgtgccaaactcgcgctggacaacatcgtcatgttgcacacgaccgagcgaggtgggcgggcctaccagcacgccctaaacgagttgccagagagcctggagacgctcatgctagtggcccttctcggcgcgatgaccgccgggattttcctgttcttcatgcagggcaaggggattggcaagctgagcatgggactcatcaccatcgccgttgcctccggcttgctgtgggtcgccgaaattcaacctcagtggatagcggcaagcatcatccttgagttctttttgatggtgctgctcatcccagagcccgagaagcagcgcaccccccaggacaaccagttgatttacgtgatcctgacgatcctcaccattatcggcttaatcgccgcgaacgaaatggggttgatagagaagaccaagaccgacttcggcttctatcaggttaaaactgagaccacaattctcgacgtggatttacggcctgcctccgcttggaccctctacgccgtcgccaccaccatcttgaccccgatgcttaggcataccatcgagaacacgagtgccaacctgtccctagcagcaatcgccaaccaggccgccgtcctgatgggactgggcaaaggttggcccctccaccgcatggacctgggggttcccctgctcgccatgggctgctacagtcaggtgaatcccaccaccctgaccgcctccctcgtcatgctcctcgtgcattatgcgatcatcggtccgggcttacaagccaaggccacgcgggaggcgcagaaacggaccgctgccggcatcatgaagaacccaaccgtggatggtatcaccgtcatcgacttggaacccatcagctatgatcccaagttcgagaagcagctggggcaggtcatgctgctcgtgctgtgcgccggtcagctcctcctaatgcgcacgacctgggctttctgcgaggtcctgaccctcgcgaccggcccgatcctgacgctgtgggaggggaaccccggtcggttctggaacacaaccatcgccgtgtccaccgccaatatcttccgcggcagctacctcgccggggccggactggcgttctccctgatcaagaacgcccagaccccccgaagagggacaggcaccgctggcgagaccctcggcgagaagtggaagcgacagctgaactccttagaccggaaggagttcgaggagtacaagcggtccggcatcctcgaggtggacaggacagaggccaaaagcgcactgaaggacgggtccaagattaagcatgcggtcagccggggctcaagcaagatccgctggatcgtggagcgcgggatggtgaagcccaagggcaaggtagtggacttgggttgcggccggggcggatggagctactacatggccacgcttaagaacgttaccgaggtcaagggttacaccaagggaggcccggggcacgaggagcccatccctatggccacctacggctggaacctggttaaactgcacagcggcgtggacgttttttataagccgaccgaacaggtggacaccctcctctgcgacatcggggagtcaagctcaaatccgaccatcgaggagggacgcaccctgcgggtcctcaagatggtagagccctggctgagcagtaaacccgaattctgcatcaaggtgctgaacccctacatgcccacggtcatcgaggagctggagaagctccagcgcaaacacgggggcaacctggttcgatgccccctgtcccgcaacagcacacatgagatgtactgggtgagtggcgcctccgggaatatcgtgtcctcggttaacacgacatccaagatgctcctgaatcggttcacgacccgccaccggaaacctacatatgagaaggatgtggatctaggggcggggactcgcagcgtctccactgagatcgagaagcccgacatgaccatcattggccggcgcctgcagcggttgcaggaggagcacaaggagacatggcattatgaccaggaaaacccgtaccgcacctgggcctaccacgggagctatgaggctccgtcgacgggcagcgcctccagtatggtgaacggggtggttaaactgcttaccaagccctgggacgtgatccctatggtgacccaactggcaatgaccgacacgacccctttcgggcagcagcgtgtatttaaagagaaggttgacacccgcaccccccagcccaaacccggtacgcgaatggtgatgacgaccaccgccaactggctctgggcactcctgggaaaaaagaaaaacccccgcctatgcacgagagaggagttcatctccaaggtcaggagtaacgccgccatcggtgccgttttccaggaggagcaggggtggacctccgcgagtgaggccgtgaacgacagccggttctgggagctcgtggacaaggagcgcgcactgcaccaggagggcaaatgcgagtcttgcgtgtacaacatgatgggcaagcgcgagaagaagttgggggagttcggccgggctaaggggagccgcgccatatggtacatgtggcttggcgcccggttcctggagttcgaggccttagggttcctcaacgaagaccactggttcggccgcgagaactcctggtcgggcgtggagggggagggcctgcatagactggggtatatccttgaggagatagataagaaggacggggacctgatgtacgccgacgacaccgccggctgggacacccgcattacggaagacgacctacaaaacgaggagctgatcaccgagcagatggcgccacaccacaagattttggctaaggccatcttcaagctgacgtaccaaaacaaagtcgtgaaagtgctccggccgacgccccgcggtgccgtcatggacattatctctcggaaggaccagcgcggcagcgggcaagtgggcacatacgggctgaacacatttaccaacatggaggttcaactgatccggcagatggaggcggaaggggtgatcactcaagacgatatgcaaaaccctaagggcctgaaggagagggtggaaaagtggctgcgggagtgtggggttgaccgcctgaaacggatggcgatctctggcgacgactgcgtcgtgaagcccctagatgagcgcttcgggacttcattattgtttctcaacgacatgggaaaggttcgaaaggacatcccacagtgggagccctccaagggctggaagaactggcaggaggtccccttctgtagccaccactttcacaagatcttcatgaaggatggtcgctccctcgttgtaccctgtcgtaatcaggacgagttgatcggcagagctcgcatcagccagggggccggctggtccctccgggagactgcctgcctggggaaggcctacgcgcagatgtggtcccttatgtatttccaccgcagggacctccggctagcctccatggccatctgcagcgctgtccccacggagtggttcccgacgagccgtaccacttggtctatccacgcccatcaccagtggatgacgactgaggacatgctgaaggtttggaaccgcgtgtggatcgaggacaatcccaatatgatcgacaagaccccggtccacagctgggaagacatcccctatctcggcaagagggaagacctgtggtgcggctccctgatcggcttatcgagccgcgctacgtgggcgaagaacatacatacagctatcactcaggtgcgaaacctgatcggcaaggaggagtacgtagattacatgagcgtaatgaaacgctactccgccccgagcgagtccgagggggtcctgtga

SEQ ID NO: 26225 - RNA, 9867 nt, synthetic construct
  misc_feature 1..9867: note = derived and/or modified CDS sequence (opt11) from DENV-4__KP188564__SS-prME
  source 1..9867: mol_type = other RNA
agcaccattaccctcctgtgtctgatccccacggtgatggcgttccatctcagtactcgcgatggcgaaccgctcatgatcgtcgccaagcatgagcgggggcgccctttgttgttcaagaccaccgaaggcattaacaaatgcacgctcatcgcgatggacctgggcgaaatgtgcgaagataccgtgacctacaagtgtccgctcctggttaatacagaacccgaagacatcgattgctggtgcaatctgacgagcacttgggtcatgtatggcacctgtacccagagcggggaacggcgacgggagaagcgcagcgtagcgctgaccccgcattccggaatgggcctcgagacccgtgcagagacctggatgagctccgaaggcgcctggaagcacgcccagcgcgtcgagagctggatcctgcgcaacccgggcttcgcgctgcttgccggcttcatggcctacatgattgggcagaccgggatccagcgcacagtattcttcgtgctgatgatgctggtggcgccctcctacggaatgcggtgcgttggagtgggaaacagggacttcgtggagggagtcagtggaggcgcctgggttgatctcgtgcttgagcatgggggatgcgtcacaaccatcgcccagggaaagccaaccctagacttcgaactcacgaaaacaaccgccaaagaggtagccttgctgcgtacctactgcatcgaggcgctcatctcaaacataacgaccgcaaccaggtgcccgacgcagggggagccctacctgaaggaagagcaggaccagcaatacatctgcagacgtgacgtagttgatcggggctgggggaacggctgcggactgtttgggaaaggcggggtggttacgtgtgctaagttctcttgcagtggaaagatcaccgggaatttggtacagatcgaaaacctggagtacaccgtggtagtcaccgtacacaatggtgacacacacgctgtcggcaacgacacatcgaaccacggggtgaccgcgaccataacaccgcgatcacccagcgtggaggtcaagctgccggactacggcgagctcaccctggactgcgagccccggtccgggatcgacttcaatgaaatgatcctgatgaagatgaagaagaaaacctggctcgtgcacaagcagtggtttctggatctgcccctcccctggacaacgggcgccgatacgagcgaggtgcactggaactataaggagcgcatggtcacattcaaggtaccgcacgcgaagcgccaggatgtgaccgtcctggggtcacaagagggcgcaatgcatagcgcactggctggcgccaccgaagtcgacagtggggacggcaaccacatgttcgcgggccacttgaagtgcaaggtgcgcatggagaagctccgcatcaagggaatgagttacacgatgtgcagcggcaagttctccatcgacaaggagatggccgagacccaacacgggaccaccgttgtcaaaattaagtacgagggtgcgggggccccatgcaaggtgcccatcgaaattcgggacgtcaataaggagaaagtggtgggccgcgtcatcagcgccacgcccctggcggagaacaccaattccgtgactaacatcgaattagagccgccctttggggactcctacatcgtgatcggggtcggcaactcggccctgacccttcactggtttcgtaaggggagctccataggcaagatgttcgagtcgacgtaccgcggggccaagcggatggccatccttggcgaaactgcgtgggacttcgggtccgtgggcggcctgttcacgagcctaggcaaggccgttcaccaggtcttcggctccgtgtacacaacaatgttcgggggggtgtcttggatgatccgaatcctgatcgggttcctcgtactgtggatcggcacgaattcgcgcaacaccagcatggctatgacatgcatcgccgtcggcgggatcacactgtttctcggcttcaccgtgcaggccgacatggggtgcgtcgtaagctggagcggccgcgagctgaagtgcgggtccgggatctttgtggttgacaacgtgcacacctggaccgaacagtacaagttccagccagaatctccggcacgccttgccagcgccatccttaacgcccacaaggacggtgtttgcggcatccgctccacgacgcgactcgaaaatgtaatgtggaagcagataactaatgaactgaactacgttctctgggaaggcggacacgatctaacagtagtcgcgggtgacgtgaagggcgtgctgacgaagggaaaacgcgcgctcacaccgcctgccagcgatttgaagtactcctggaagacctggggaaaagccaagatcttcaccccagaggcccggaacagcacgtttctgatcgacgggcccgatacgtccgagtgcccgaacgaaagaagggcatggaacagctttgaagtggaggactacggcttcgggatgttcacaactaacatctggatgaagtttagggagggctccagcgaggtgtgcgaccaccggctcatgtccgctgccatcaaggaccagaaggctgtccacgcggacatgggctactggatcgagtcgtccaagaaccagacctggcagatcgaacgcgccagcctgattgaggtaaagacctgtctttggccgaagacccacaccttatggtccaatggagtactagagtcgcaaatgttgatccccaagtcttacgccggcccgttctcgcagcacaactaccgtcagggatacgccacccagactgttgggccctggcacctggggaaactggagatcgacttcggcgagtgccccggcacaacggtcaccattcaggagaactgcgatcaccgcgggccctccctgcgcacgacaaccgccagcggcaagctcgtgacccagtggtgttgccggagctgcacgatgccgcccctgcgcttcctgggggaggacggatgctggtacgggatggaaatccgtcccctatccgagaaggaggagaacatggtgaaaagtcaggtaaccgcaggacagggcaccagtgagactttctccatggggctgctgtgcctcacgctgttcgtggaggagtgtttgcgccgtagagtcacgcggaagcacatgatcttagcggtggtcatcaccttatgcgccatcatcctgggagggctcacttggatggacctgttacgagccctcatcatgctgggagacacaatgtccggacggatcgggggccagacgcacctcgccattatggcagtcttcaagatgagcccggggtacgtgctcggagtgttcctacggaaactgacttccagggagactgcactcatggtcatcggaatggccatgacgacgaccttgagcataccgcacgatctgatggagctcatcgacggtatctccttaggcctaatactcctgaaaattgtgacccaattcgacaacacgcaggtggggacgctggccctaagcctgaccttcatccgctcgaccatgagcttagtcatggcctggcgaacgatcatggccgtgctcttcgtggttaccctgatccccctgtgtcgcacctcctgtctacagaagcaatcgcactgggtggagatcaccgcgctgatactgggagcccaagctcttcccgtatacctcatgaccctgatgaagggagcctcccggcgcagctggcccttgaacgagggaattatggcggtcgggctggtctcgctgctcggctctgccctcctcaagaacgacgtgccgctggcaggtccaatggttgcggggggcctcctactcgcagcgtatgtaatgagcggcagcagcgccgacctctccctggagaaggccgccaatgtgcaatgggatgagatggcagacatcaccggaagcagtccaataattgaggtcaaacaggacgaggatgggtcgttttcgatcagggacgtagaggaaactaatatgatcaccctcctggtaaagctggcgctcatcacggtgagtggactgtacccattagcaatccctatcacaatgacactctggtacatgtggcaggtgaagacccagcgttcaggtgctttgtgggacgtaccatcgcccgccgctacccagaaggctgccctgagcgagggggtctacaggattatgcaaaggggactcttcgggaagacgcaggtgggcgtcgggatccacatggaaggggtcttccacaccatgtggcacgttacccgtggcagcgtaatctgccacgaaacaggacggctggagcccagctgggcggacgtgcgaaacgacatgataagctatggtgggggatggcggctgggagacaagtgggacaaggaggaggacgtgcaggtgctggccatcgagccggggaagaacccaaagcacgtccagacgaagccaggcctgttcaagactctcactggggaaataggcgcggtgactcttgatttcaagcccggcacctccggcagtcccatcatcaaccgcaaggggaaggttatcgggctttacggcaatggtgtggtgaccaagagcggcgactacgtttccgcgatcacccaggccgagcggatcggggaacccgactacgaggtcgacgaggatatcttccgcaaaaagcggctcaccatcatggacctccaccccggggccgggaagacgaagcggattttaccctcgatcgtgcgggaagccctgaagcgtcggctgagaaccctcatcctggcaccgaccagggtggtcgccgctgagatggaggaggcactgagggggctccctatccgatatcagacccccgcagtgaaaagtgagcacacaggtcgcgagatcgtggacctgatgtgtcacgcgacctttacgacaagactgttgtccagcacgcgcgtcccgaactacaatctgattgtgatggatgaagcccatttcacagacccatcgtccgtggccgcccggggttacatcagcaccagggtcgagatgggcgaagccgcggccattttcatgaccgcaacgccgccgggggccaccgacccgtttcctcagtccaacagccccattgaggacatcgagcgtgagattcccgaacgcagttggaacacgggctttgactggataaccgactaccagggcaaaactgtctggtttgtcccgagcatcaaggctgggaacgacatcgcgaactgcttgcgcaaaagcggcaagaaggtgattcaactgagccggaagacgttcgacaccgagtaccccaagaccaagctgactgactgggacttcgtggttaccacagacatttccgagatgggcgccaacttccgcgccggtcgggtgatagacccccgccggtgtttgaagcccgtgattctcaccgacggtccggaaagagtgatcctggccgggccgatccccgtgacgcccgcttcggccgcccagcggaggggccggatagggcgtaacccggctcaagaggacgaccagtacgttttctcaggcgacccgctgaagaacgacgaggatcatgcccactggactgaggcgaagatgcttctggacaacatatacacccccgagggtatcatccccaccctgtttggcccggagagggagaagacccaggccattgacggcgagtttcgcctccggggggaacagcgcaagaccttcgtagagctgatgcggcgcggcgacctgcccgtatggttaagctacaaggtcgcctccgccggaatcagctacaaggatcgcgaatggtgtttcaccggggaacgcaataaccagatacttgaggaaaacatggaggtagaaatctggacccgggagggcgagaaaaagaagctgcgccccaagtggctcgatgcgcgggtgtatgcggaccccatggccttgaaggacttcaaagagtttgcctccggccgcaagagcattacactggacatcctcacggagatagcctccctgccgacctacctgagcagtcgagcgaaattggcgttggacaatatcgtcatgctacataccaccgagcggggcggccgagcctaccagcatgccctcaacgagcttcctgagagcctggagacgctcatgctagtcgcgcttctcggcgcgatgacagccggcatcttccttttctttatgcaaggcaaagggatcggcaaattgtcgatgggcctcatcacgatcgccgtggcctccggtctgctgtgggtagccgaaatacagccccagtggatcgcagctagcatcatcctagagttcttcctaatggtcctgcttatcccagagcccgagaagcagcggaccccccaggacaaccagctgatctatgtcatcctgacgatactcacgatcatcggcctgatcgcggctaatgagatggggctgatagagaagacgaagaccgacttcggattttaccaagtgaaaaccgagaccacaatcctggacgtggaccttaggcctgcctccgcatggacgctttacgcggttgcgacgaccatactcactccaatgctgagacacaccatagagaacacgagcgcaaacctgtccttagccgcgatagccaaccaagccgccgtgctgatggggctcggcaagggctggcccttacacaggatggacctgggagtgcctcttttggccatgggctgctacagtcaggtgaatcccacaacactcaccgcgtccctggtaatgttactggtccattacgctatcatcgggccgggactgcaggccaaggccacccgtgaggcgcagaagcgaaccgccgccggaataatgaaaaaccccactgtggatgggatcacagttattgacctcgagcccatcagctatgaccccaagtttgaaaagcaactgggccaggtgatgcttctggtactgtgtgccgggcagttattgctcatgcgaacaacctgggcattttgcgaggtgctgacgctcgcgaccggcccgacgctaaccctctgggaaggtaaccctgggcggttttggaacaccacaatcgccgtctccactgccaacatttttcggggctcttacctcgccggggctggcttggcgttctccttaatcaagaacgcccaaacaccccgccgtgggacgggaaccgccggggagacccttggcgagaaatggaagcgccagctgaactccctagaccgcaaggaattcgaggagtacaagcgttccggcatcctcgaagtagacagaaccgaagccaaaagcgcactgaaagatggttcgaagatcaagcatgccgttagcaggggctcctcgaagatccggtggatcgtcgagcgcgggatggtgaagcccaaaggcaaggtggtggacctcggatgcggacgcgggggttggtcctattacatggccactctcaagaacgtgacagaggtcaagggttacaccaagggaggtccgggacacgaggaacccatccccatggctacatacggctggaacctggttaagttgcatagcggcgtggacgttttttacaaacccacggaacaggtcgacacactcctatgcgacatcggagagagcagttcgaacccgaccatcgaggagggtcggacgctgcgcgtgctgaagatggtggagccctggctgtcctcgaagcccgaattctgcatcaaggtccttaacccatacatgccgactgtaatcgaggagcttgagaagttacaacggaaacatgggggcaacctggttcgctgcccactgtcccggaactcaacccacgaaatgtactgggtcagcggcgcgagcgggaacatcgtgagtagcgtcaacacgaccagcaagatgctcctgaaccgcttcacgacccggcaccgaaagccaacttatgaaaaggacgtggacctgggcgcggggacaagaagcgtgtccactgaaaccgagaagcccgacatgacgatcatcggccgccggctccagagacttcaggaggaacataaggagacctggcactacgaccaggagaacccgtaccgcacctgggcctatcacgggtcatacgaagcacccagcaccggcagcgcatccagcatggttaacggtgttgtgaagctgctcaccaagccgtgggatgtgattcccatggtgacgcagcttgccatgaccgacactaccccgttcggacagcagcgcgtcttcaaggagaaggttgatacacggaccccccaaccgaagccaggcacccgcatggtgatgaccacgaccgcgaattggctctgggcccttttggggaagaagaagaacccccggctgtgtacacgcgaggagtttatctctaaggtgcgaagcaacgcggccatcggtgccgtcttccaggaggaacaagggtggaccagcgcgaacgaggccgtaaacgactcccgtttctgggagctcgtggacaaagaacgggccctacaccaagaaggcaaatgcgagagctgcgtgtacaatatgatgggcaagcgcgagaagaagctgggtgaattcggcagagctaaggggtcccgggctatctggtacatgtggttgggtgcgcgcttcctggaattcgaggccctaggcttccttaacgaggaccactggttcggacgggagaactcatggtctggcgtggagggggagggcttacaccgtttggggtacatcctcgaggagatcgacaaaaaggacggcgatctaatgtatgcagacgacacggctggctgggatacccggatcaccgaagatgacctgcagaacgaggagttgatcaccgagcagatggcgccacaccacaagattctggccaaggccatcttcaagctgacctaccagaataaggtggtcaaggtgctccgtcccacgccgcgcggggcagtcatggatattatctccagaaaggaccagcggggcagcgggcaagtggggacatatggactgaacacctttaccaacatggaggtgcagcttatccgccagatggaggctgaaggagtaataacacaggacgatatgcagaaccccaagggcctgaaggagcgggtcgagaagtggctacgcgaatgcggggtggatcgtctgaagcgcatggcaatttctggggacgactgcgtggtgaagcctttagacgagcggttcggaacctcccttcttttcctcaatgacatgggcaaagtgcgtaaagatatcccacagtgggagccgtcaaaggggtggaaaaactggcaggaggtgcccttctgctcccaccactttcataagatcttcatgaaggatggtaggagcctggtcgtaccgtgtcgcaaccaggatgagctgatcggacgggctcgcatctcccagggggcgggctggagcctcagggaaaccgcctgtctggggaaagcgtacgcacagatgtggtccctgatgtacttccatcggcgggacctccgtctggcctctatggccatctgctcagccgtgcccaccgagtggttccctacgtcgcgcaccacctggagcatccacgcacaccaccagtggatgaccacggaggacatgctgaaggtgtggaaccgggtctggatcgaggataaccccaacatgatcgacaagaccccggtacactcctgggaagacatcccatacctcggaaagcgcgaggatctgtggtgcgggagcctcatcggcttgtccagtagagcgacgtgggctaaaaacatacataccgccataacgcaggtgcgcaacctgattggcaaagaggagtacgtggattacatgcctgtgatgaagcggtactcagcccccagcgagagtgagggggtcctgtag

SEQ ID NO: 26226 - RNA, 9867 nt, synthetic construct
  misc_feature 1..9867: note = derived and/or modified CDS sequence (opt11) from DENV-4__JN983813__SS-prME
  source 1..9867: mol_type = other RNA
tcgaccatcaccctgctctgcctgatccccacggtgatggctttccacctgtcgactcgggatggagaaccgctcatgatcgttgctaagcacgagcgggggagaccgctgttgtttaagaccactgaagggataaacaagtgcacgctcattgcgatggacctaggtgaaatgtgcgaggacactgtgacttacaaatgccccttactcgtaaacaccgagcccgaggatatcgattgctggtgcaacctgacgagcacctgggtgatgtatgggacttgcacccaaagcggggagcggcgccgcgagaaacggagtgtagccctgacgccgcactccggcatgggcttggagactcgggctgagacctggatgagctccgagggggcttggaagcacgcccagcgcgtggagtcctggatactccggaatcccggtttcgcgctgctcgcggggttcatggcgtacatgatcggtcaaaccggcattcagcgcacggtcttcttcgtgctgatgatgctggtggcgccctcctacggcatgcgttgcgttggcgtaggtaacagggacttcgtggaaggcgtaagcgggggcgcgtgggtagacttggtgctggagcacggcgggtgtgtcactaccatggcccaggggaagcccaccttggacttcgagctcacgaagaccactgctaaagaggtagcactactgcggacctactgcatcgaggccctcatttccaacatcacgacggcaacccgctgcccaactcaaggggagccctatcttaaggaggagcaggatcagcagtacatttgccggcgcgatgttgtcgatagaggctgggggaacgggtgcggcctgttcggaaagggaggcgtggtaacttgcgctaagttcagctgctcgggaaagattaccggcaacttggttcaaatagaaaacctggagtacaccgtcgtggtcaccgtacataatggcgacacgcatgccgttggcaatgacacaagtaatcatggggtgaccgctaccatcacgccccgctctcccagcgttgaggtcaagctgcctgactacggtgaattaaccctggattgtgaaccccgctcggggatagacttcaacgaaatgatcctgatgaagatgaagaagaagacctggctagtgcataagcaatggtttctggacctgcccctcccctggacgactggagccgacacgagcgaggtgcattggaattataaggagcgcatggtcacattcaaggtgccccacgcgaaacggcaggacgtaaccgtattggggtcgcaggagggcgcgatgcactcggccctagcaggcgcgacagaagtggacagcggggacggcaaccacatgttcgcggggcaccttaagtgcaaagttcgcatggagaagctgcgtatcaagggcatgtcctacacgatgtgcagcggcaaattctccatcgacaaggagatggccgagacccagcacgggaccaccgtcgttaaggtgaagtacgagggggccggggcgccctgcaaggtccccattgaaatccgagatgttaacaaggagaaggtggtgggacgcgtgatctcagccacgcccctagcggagaacactaattccgtgacaaacatagagctggagccgcccttcggggacagttacatcgttatcggcgtcggcaactccgctctgaccctgcattggttccggaaaggatcctccatcggcaagatgttcgagagcacatatcgcggggccaagcggatggcgattctcggcgagacggcatgggacttcggatccgtgggcggtctgtttacctcattagggaaggccgtacaccaggtgttcggctccgtctacaccaccatgttcgggggcgtgagctggatgatccgcatcctcattggtttcctggtgttatggataggcacgaactcccgcaacaccagcatggccatgacctgcatcgcagtcggagggatcacgctgttcctcggcttcaccgtccaagccgatatggggtgcgtcgtgtcctggagcggacgcgagctgaaatgtgggtccggcatctttgtcgtggataacgtacacacttggaccgagcaatataaatttcagcctgagtccccggcccggctggcctccgccatcctgaacgcacacaaggatggcgtctgcgggatccgctccacgacccggttagaaaacgtgatgtggaagcagatcaccaatgagctgaactacgtgctctgggaaggagggcacgacctgaccgtcgtggccggagacgtgaaaggagtcctgacgaaggggaagcgcgctctcaccccgccagccagtgacctgaagtattcctggaagacctggggtaaggcgaagatcttcacccccgaggcccggaacagcaccttcctcattgatgggccggacacatcagaatgcccgaacgaacgccgagcctggaactcttttgaggtggaggactacggattcgggatgttcaccactaacatctggatgaaattccgcgagggctccagtgaggtgtgcgaccaccggctcatgagcgcggccatcaaggaccagaaggccgtccatgcggatatgggctattggatcgaaagcagcaagaaccagacctggcagatcgagcgcgcgagcctgatcgaggtaaagacgtgtctgtggcccaagacccacactctgtggtccaacggagtactggaaagccagatgctgatccccaagtcctacgcgggacctttcagccagcacaactaccggcaggggtacgcaacccaaacggtcggcccctggcacttagggaaattagagatcgactttggagagtgccccgggaccaccgttaccatacaagaaaactgcgaccataggggtccctccttgcgtaccacgaccgccagcggaaaactggtgacccagtggtgctgtcggtcctgcacgatgccgcccctgcgcttcctaggggaggacggctgctggtatgggatggagatccggcccctatccgaaaaggaggaaaacatggtgaagagtcaggtgaccgccggccagggtacatccgagactttctctatgggcttactgtgcttaacgctgttcgtggaggagtgcctgcggaggcgcgtgacccggaagcacatgatcctggcggtggtcataaccctgtgcgccattattctgggagggctcacgtggatggacctccttcgagccctgataatgctaggtgacacgatgtccggccggatcggaggtcagacccatttagccatcatggcggtgttcaagatgagcccaggctacgtgctcggggttttcctgcgcaagctgacaagccgggaaaccgccctcatggtgatcgggatggcgatgacgactacactgtcgatcccccatgatctaatggagctcatcgacggtatctccctgggcctgatcctcctgaaaatcgtaacccagttcgataacactcaagtcgggaccctggctctctcactgacgttcatacggtccacgatgagcctggttatggcctggaggacgataatggccgtgctgtttgtcgtaaccctcatccccctgtgcagaaccagttgcttacagaagcagagccactgggtggagattaccgcgctgatactcggtgctcaagcgttacccgtatacctcatgacacttatgaagggggcctcccggcgcagctggccactcaatgaggggataatggcggtggggctggtgtccttactcggcagcgccctgctcaagaatgacgtgccactagccgggcccatggtggccggagggctgctgctcgccgcgtacgtgatgtccgggagcagcgcggacctgtcccttgagaaggccgctaacgtccagtgggacgagatggccgacatcaccggttcctcccctatcatcgaagtgaagcaggatgaggacggaagtttctccatcagagacgtcgaggagaccaatatgataacgctcttggtcaagctagcgctcattacggtatctggcctgtatcctctggctatcccgatcacaatgaccctctggtacatgtggcaggtcaaaacccagcgctccggagccctgtgggacgtgccgagccccgccgcaacacagaaggccgccttatcagagggggtgtaccggatcatgcagagaggtctgttcggaaagacacaggtgggagttgggatccacatggagggggtattccacaccatgtggcatgtgaccagaggcagcgtcatctgccacgagacagggcgcctagagccgtcttgggctgacgtacgcaacgatatgatcagttacggcgggggatggcggcttggcgacaagtgggacaaggaggaggatgtccaagtgctcgccattgagcctggcaaaaatcccaaacatgttcagacaaagccgggcctgttcaagactctgaccggggagatcggcgccgtgacgctcgatttcaaaccgggtacgagtggcagccctataattaatcgcaagggtaaggtcatcgggctttacggcaacggagtggtgaccaagtcgggagattacatttcggcgattactcaggcggagagaatcggggaaccagactacgaggtggacgaggacatcttccgcaaaaagagactaaccattatggacttacaccccggagcaggtaagacgaagcgaatcttaccgtccatcgtgagagaggcgctgaaacgccgactccgcacgctcatcctggcgcctaccagagtcgtcgccgcagagatggaggaggcactgcgagggttacccatccgctaccagacccccgcagtaaaatccgagcacacgggccgggagattgtcgatctcatgtgtcacgcgaccttcaccaccagactgctcagctcaacgcgcgtgccgaactataaccttatcgtgatggacgaagcgcacttcaccgatccaagctccgtagctgcgaggggatacatctcaacccgcgtcgagatgggcgaggctgcggccatcttcatgaccgccacgcctccgggggccaccgacccgtttccccagtccaatagccccatcgaggacatagagcgggagatacccgagcgatcctggaatacaggcttcgactggataactgactaccagggcaagacggtgtggtttgtaccgagcatcaaggctggaaacgacattgccaactgcttacgcaaatctggcaagaaggtgatccagctcagccggaagactttcgataccgagtaccccaaaaccaaactgaccgattgggacttcgttgtaaccaccgacatcagcgagatgggggcgaacttccgagccggccgggtgatcgacccccgacggtgcctgaagccagttatcctcactgacggtccggagcgcgtgattctcgccggccccatccccgtcacgccagcaagcgccgcccagcggaggggccggatcggtcgcaaccctgcgcaggaggacgaccagtacgtcttttccggcgaccccctgaagaacgacgaggaccacgcgcattggaccgaggcgaagatgctcttagacaatatctacacccccgaggggatcatccccaccctgttcgggccggagagagaaaagacccaagccatcgacggcgagttccgcctgagaggggagcaacgcaagaccttcgtcgagttaatgcgccggggcgatctgcccgtatggttatcgtacaaggtagcatccgccggcatctcatacaaggaccgtgaatggtgttttaccggcgagcgtaataatcaaatactagaggaaaacatggaagttgagatctggacccgggaaggcgagaagaagaagctgcgccccaagtggttggacgcacgtgtgtatgcggaccctatggcccttaaggacttcaaagaatttgcttccggccgcaaaagcatcacccttgacattctcaccgaaatcgccagcctgccgacatacctgagctcccgtgcgaagctagcgctggataacatcgttatgcttcataccacggagcggggtgggcgcgcctatcagcacgctctcaacgagctccccgagagtctggagacactcatgctggtcgccttactcggcgcgatgacagcaggaatcttcttattcttcatgcaaggcaagggaatcggcaagctgagcatggggctcataaccatcgcggtggcctcggggctgctatgggtagccgagatacagccccaatggattgcagcctccattatactcgagttcttcctgatggtcttgttaatcccagagcccgagaagcaacggacaccccaggacaatcagctgatctacgtgatcctgacgatcctcaccattatcggccttatcgccgccaacgagatggggctgatcgaaaagaccaagaccgactttggcttctaccaggtgaagacggagaccacaatcctggacgtggacttgcgacccgcctccgcgtggaccctgtacgccgtggcgacaacaatactcaccccgatgctgcgacacaccatcgaaaacactagcgccaatctgtccttagctgcgatcgccaatcaggccgccgtgctgatgggactaggcaagggctggcccttacacaggatggatctgggtgtgcccctgctcgccatggggtgctactcacaggttaacccaaccaccttgacggcgtcgctggtgatgctcctggtgcattacgccataatcgggccgggcctgcaggccaaagctacgcgagaggcacaaaagcgcaccgccgccggcatcatgaaaaaccctaccgttgacgggatcacggtgatagatctcgagcccataagttacgaccccaaattcgaaaaacagcttggacaagtaatgctgttagtgctttgtgccgggcagctgctcctgatgcggacgacctgggccttctgcgaggtcctgacactcgcgaccggcccgatactgaccttgtgggagggtaatccggggaggttctggaacaccaccatcgccgtctctaccgccaacatcttccggggcagctaccttgcaggggccggcctggcgttctccctgatcaagaacgcccagactccccgccgaggtaccggcactgccggagagacgctcggcgagaaatggaagcgacagctgaactcactggaccggaaggagtttgaggagtacaaacgtagtggcatactcgaggtggaccgaacggaggcaaagagcgcactgaaggacggttccaagattaagcatgcggtcagcagagggtccagcaagatccggtggatagttgagcgcgggatggtgaagcccaagggcaaggtcgtagaccttggatgcggccgaggcggctggtcctactacatggccacgctcaagaacgtgaccgaagtgaagggatacactaaagggggcccgggccacgaggagccaataccgatggcaacctacgggtggaatctggtcaagctgcacagtggcgtggacgtattctataaacccacggaacaggtcgacacactcctgtgtgacatcggggagtcttccagcaacccgaccatcgaagagggccggaccttaagggtgctgaagatggtggagccctggctgtccagcaaacccgaattttgtatcaaagtcttgaatccctacatgccgaccgtgatcgaggaactcgaaaagctccaacgaaagcacgggggaaatctggtgcgatgccccctgtccaggaacagcacccacgagatgtattgggtctccggcgccagcggtaatatcgtgtcctcagtcaacaccacttcgaaaatgctgctgaatcgcttcactacccggcaccgcaagcccacctacgagaaggacgtggatctgggcgcggggacaaggagcgtgtccacggagaccgaaaagcctgacatgactatcattggccgtcgcctccagcgcctgcaggaggagcacaaggagacctggcactatgaccaggagaacccgtaccggacgtgggcgtatcacgggagctacgaggccccctccaccggctcagcctctagcatggtcaacggcgtggtcaagctgctgactaagccctgggatgtcataccgatggtgacacagctggcaatgacggacaccacccccttcgggcaacaacgtgtgttcaaggaaaaggtcgacaccaggacgcctcagcctaaaccgggtacaaggatggtgatgaccacaacggcgaattggctctgggccctcctgggaaagaagaagaacccccgtctctgcacccgtgaggagttcatctcgaaggtgcggagcaatgccgcaatcggcgccgtctttcaggaggaacaggggtggaccagcgcttctgaagccgtgaacgacagccgtttctgggagctcgtggacaaagagcgggccctacatcaagagggcaagtgcgagagctgcgtctataacatgatggggaaacgcgagaaaaagctgggggagtttggccgcgccaaggggagccgagctatctggtacatgtggctcggcgcgcgcttccttgagtttgaggcccttgggttcctaaatgaggatcactggttcgggcgggaaaattcttggagcggcgttgagggcgagggcttgcaccgccttgggtatatccttgaagaaatcgacaagaaggacggcgacctgatgtacgctgacgacaccgccggctgggacacgcgtatcaccgaggatgatctgcagaatgaggagctgattaccgagcaaatggcgccccaccataagatcctggccaaggcgatattcaagttaacctaccagaacaaggtcgtaaaggtactccgccccaccccgcgtggggcggtcatggacatcatctcccgaaaggaccagcggggctccggacaggtgggcacgtacgggctgaatacattcaccaacatggaggtgcagctgatccgccaaatggaggccgagggcgtgatcacgcaggacgacatgcagaaccccaagggtctcaaggagcgggtcgaaaagtggcttcgcgagtgcggcgttgatcggctgaagcgaatggcgatcagcggtgacgactgcgttgtcaaacccttggacgagcggtttggtaccagcctcctttttctcaacgacatgggtaaggtacgcaaggacatcccccagtgggaaccgtcgaaagggtggaagaactggcaggaggtgcccttctgctcccatcacttccacaaaatctttatgaaggatggacggagtctcgtcgtaccttgtcgtaaccaggacgaactgataggcagagcacgcatcagccaaggggcggggtggtccctccgcgaaaccgcctgtctggggaaagcctacgcgcaaatgtggagcctgatgtacttccaccggcgcgatttgcggctggcctctatggccatctgcagtgctgtgcccacggaatggttcccgacaagtagaacgacctggtccatccacgcccatcaccagtggatgacgactgaggacatgcttaaggtctggaaccgggtgtggattgaggacaaccctaacatgatcgacaaaacgcccgtgcacagctgggaggacatcccttacctcggcaaacgagaggacctctggtgcggttcactgatcggcctcagctcgcgggcgacctgggccaagaacattcacaccgcgatcacacaggtccgcaacctgatcggcaaagaggagtacgtagactacatgccggtgatgaagcggtacagcgccccctccgagagcgagggggtcctgtaa

SEQ ID NO: 26227 - RNA, 9867 nt, synthetic construct
  misc_feature 1..9867: note = derived and/or modified CDS sequence (opt11) from DENV-4__KF041260__SS-prME
  source 1..9867: mol_type = other RNA
agtaccattaccctcttgtgcctgatcccaacggtgatggccttccatttatcaactcgtgacggtgagccgctcatgatcgttgccaagcatgagcgggggcgtccgctgttgttcaagactaccgaagggatcaataagtgcacgctaatagcgatggacctgggggagatgtgcgaagacaccgtcacctacaagtgcccccttctggtgaacaccgaacccgaggatattgattgttggtgcaacctgacgagcgcctgggtaatgtatggcacctgtacccaatccggggaacgtcggcgggaaaagcgcagcgttgctctgaccccacactccggcatgggtctcgagacgcgcgctgaaacctggatgagcagcgagggggcctggaaacatgcacaacgcgtcgaaagctggattctgagaaatccaggcttcgccctgctagctgggttcatggcctatatgatcggccaaaccgggatacaacggaccgtattctttatcctgatgatgctggtggcgccatcttacggcatgcggtgcgtgggcgtcggcaaccgagactttgtcgagggcgtgagtggtggagcttgggtcgacttagtgcttgagcatgggggttgtgtgaccacaatggcccaaggaaagcccaccctggacttcgagctgatcaagaccacagccaaggaggtcgccctgcttcgtacctactgcatcgaggcttcaataagcaacatcacgactgcaacgcgctgtcccacccagggtgagccttatttaaaagaggagcaagaccaacagtatatctgccggcgtgacgtggtggaccggggctgggggaacggctgtggtttatttgggaagggtggggttgtgacctgcgcgaagttttcctgtagcggcaaaattaccgggaatctaatacaaatcgagaaccttgagtacacggtggtcgtcaccgtgcataacggcgacacgcacgccgtcggcaatgacacgtccaatcacggggtgactgcaactgtgacgcctcgttccccctccgtggaggtggaactaccggactacggcgagctgaccctcgattgcgagccccggagcgggatcgacttcaacgagatgattctgatgaagatgaacaagaagacctggctggtccacaagcagtggttcctcgacctgcccctcccctggaccgcaggcgccgatacgtccgaggtccactggaaccacaaagagcgtatggtcaccttcaaagtgccccatgcaaagcggcaggacgtgactgttctgggttctcaggagggcgccatgcacagtgccctgaccggagccaccgaggtcgattccggggacggcaaccacatgtttgccgggcacctgaagtgcaaagtgcgcatggaaaaactccggatcaagggcatgagctacaccatgtgtagcggtaagtttagcattgacaaagaaatggcagaaacccagcatgggacgaccgttgtcaaagtaaagtacgaaggggcgggggccccttgcaaggtacctatcgaaatccgcgatgtcaacaaggagaaggtggtggggcgtataatttccagtaccccgttcgcggaaaacactaactcggtcacgaacatcgagcttgaaccgccgttcggcgactcctacatcgtgatcggagtgggggactcagctttgacgctacactggttccgcaaggggagcagcatcggtaagatgttcgagagcacctaccgcggagccaagcggatggccattctcggggagacagcgtgggatttcgggtctgtcggcggcctgcttaccagcctcggtaaggccgtacaccaagtgttcggctctgtctataccacaatgttcgggggcgtgagctggatggtgaggattctgatagggttcctcgtgctgtggatcggcactaactcccggaacacgtcgatggccatgtcctgtatcgcggtgggagggattacactgttcctgggcttcaccgtacacgccgacatgggatgcgcggtcagctggagcggcaaggagctcaagtgcggctccggcatttttataattgataacgtacacacgtggacggagcaatacaaattccagcccgagagccccgcgcgcctggcctccgcaatactgaatgcgcacaaggatggggtgtgtggaatccggagcaccacccgactcgagaatgtaatgtggaaacagatcaccaacgagctgaattacgtgctgtgggaaggcggtcacgatttgacagtcgtcgcgggcgacgttaagggcgtgctgtccaaggggaagcgggccttggcccctccagtgaacgatttaaagtactcttggaagacctggggcaaagcgaaaatcttcacgcccgagacccgcaactccacgttcctgatagatgggcccgacaccagcgagtgccctaacgagcggcgagcgtggaacttcctggaggtggaggattacggctttgggatgttcaccacaaatatctggatgaaattccgtgagggatccagcgaagtgtgcgatcatcgcctcatgtccgcggcgatcaaggaccagaaggccgtccacgcggacatgggctactggatagagagttccaagaaccaaacgtggcaaatcgaaaaggctagcttaatagaggttaagacctgcttatggcccaagacccacaccctttggtccaacggggttctggagtcccagatgcttatccccaaagcgtacgcggggcctttcagccaacacaactaccggcaaggttacgccacccagaccatgggcccctggcaccttgggaagttggagatcgactttggcgagtgccccggcactaccgtcaccatccaagaggactgcgaccaccgcggtcccagcctgcgcacgactaccgcctcgggcaagctcgtgacccagtggtgctgccgcagctgcacgatgccgcctctgcgttttctgggagaggatggctgctggtacgggatggagattcgtcccctctccgaaaaggaagagaacatggtcaagtcccaggtaagcgcgggccagggcacaagtgagaccttcagcatggggctgctttgcctcacactgttcgtggaagaatgtctgagacggcgcgttacgcggaagcatatgatcctcgtcgtggtcacaaccttgtgtgccattatactaggcggcctaacctggatggacctactgcgcgccctgatcatgctgggaaacacgatgagctcacggatgggaggacagacccacttagctatcatggccgtgttcaagatgagccccggatatgtgctcgggatcttcctgcgaaaacttaccagcagggagaccgcgctcatggtgatcggaatggccatgacaacagtgctatcaatcccgcacgacctgatggagttcatagacgggatttcgctcggcttgatcttactaaaaatggtcacccacttcgacaacacacaggtcggaactctcgccctgtcgttgacattcataaagagcaccatgcccctggtgatggcgtggcgcacgatcatggccgtgctgtttgtggtcacactcatacccctgtgccggacttcctgcctacaaaaacaaagccattgggtggagatcacggccctcatcttaggggcccaagcactgcctgtctacctcatgactctcatgaagggcgcctcgaaacggagctggccactaaacgaggggatcatggctgtgggcctcgtaagtttgctgggaagcgccctactcaagaacgacgtccccttggctggccccatggtggccggcggtctccttctggccgcgtacgtgatgagcggctccagcgccgacctctcccttgaaaaggccgccacggttcaatgggacgaaatggccgacatcactgggagttcgccaattattgaggtaaagcaagacgaggatggcagcttctccatacgggacgtggaagagactaacatgataacgctgctggtcaaacttgcgctgatcacggtgagtgggttgtacccattagccatccctgtgaccatgacactttggtacatgtggcaggtcaaaacccagcgctccggggccttatgggacgtgccctcgcccgccgccacgcaaaaggcgacgctcaccgagggggtgtaccggatcatgcagcgcggattattcggcaaaacccaagtgggagtggggattcacatggagggggtgttccatactatgtggcatgttacgagaggctccgtgatctgccacgagagcggccgccttgaaccgtcttgggccgacgtgaagaacgacatgatcagctacggaggagggtggcggcttggcgacaagtgggacaaggaggaagacgtccaggtactagccgtggagcccggcaagaacccgaagcacgtccagacgaagcctggtctcttcaagacccttacaggagagatcggggccgtgacgctggatttcaaaccgggaacctcaggtagtcctataataaaccgcaagggcaaggtcatcggactctacggtaacggcgttgttaccaagagcggggactatgtgagcgccatcacccaggcggaacggatcggcgaacctgactatgaagtcgacgaggacatcttccgcaagaaaagactgaccatcatggatctgcatccgggcgctggcaagaccaagaggatcctcccgtccatcgtgcgtgaggcgttgaagcggcgactgcggacgctgatcctggctcccacccgcgtggtcgcagccgagatggaggaggccctgcggggcctgcctatacggtatcagacgccggcggtgaagaccgagcacacgggccgggaaattgtagatctcatgtgccatgcgacgttcacgaccaggttgctgagttcgacacgcgtccccaattataacctcatcgtgatggatgaggcgcacttcaccgatccatcctctgtggccgctcggggctacatcagtacacgtgtagagatgggggaggctgccgcgattttcatgaccgccactccaccgggcaccaccgaccctttcccacagtctaactcccccatcgaggacatcgagcgcgagataccggagagaagctggaatactgggttcgactggatcacggactaccagggcaagacagtatggtttgtcccctcgatcaaggctggcaacgacattgccaactgtctcagaaagagcggcaagaaggtcgtccagctgtcccggaaaacattcgacaccgagtaccccaaaaccaagctcaccgactgggactttgtagtgactaccgacattagcgagatgggcgccaacttcagggctggccgggtgatcgacccccgccgctgtctgaagccggtcattatcacggatggaccagagcgggtgatactggcaggtccgattcccgtcaccccagcctccgccgcccagagacggggcagaatcggccggaatcccgcacaggaggacgaccaatacgtgttctctggggatcccttgcgtaacgacgaagaccatgcgcactggacggaggcaaagatgctgctggacaacatccacacccccgagggtatcatcccaactttgttcggtcccgagcgggagaagacccaggccatcgacggcgagttccgtctgcggggcgaacaacgcaagacctttgtggaactgatgcggcgcggggacctccccgtgtggctgtcctataaggtcgccagtgccggaattagctacaaggacagggaatggtgcttcaccggggaacgaaacaaccagatcctggaggagaacatggaggtcgagatctggacccgcgagggtgaaaagaagaagctccgcccgaagtggctggatgcacgggtgtatgccgacccggttgccctcaaagacttcaaggagtttgcgagcggccgcaagagcatcacactcgacatcctgacggagatagccagtctccccacgtatctctccagccgggccaaactggccctagataacatcgtgatgttacacacaaccgagcgcggcggcaaggcttaccagcacgcgctgaatgagttacctgagagccttgagaccctgatgctggtggccctcttgggggcaatgacggcgggtatattcctcttctttatgcaagggaaggggatggggaagctatcgatgggccttatcgcgatcgcggtcgccagcggtttactttgggtggccgagattcaaccgcagtggatcgcggccagcatcatccttgagttctttctgatggcgcttctgatcccggaaccggaaaaacaacggacaccccaggacaaccaactgatttacgtgatcttaaccattctgacgatcattggccttgtcgccgctaatgagatgggtctaatcgaaaagacgaagaccgacttcgggttctaccaagtgaagacagagaccacgattctagacgtggacctgaggccggcaagcgcctggaccctctatgctgtggccaccaccattctcacgccgatgctgcgtcacacaatcgagaacacctctgctaacctctcccttgccgcgattgccaaccaggcggctgtgttgatgggcctggggaaagggtggccccttcatcggatggacctgggagtgccactcttggcgatgggttgctactcccaagtcaaccctaccacactgaccgcgtccctcgtgatgctactggtgcattacgccatcatcggcccgggtctacaagccaaggccacccgcgaggcccagaagcggaccgccgccggtatcatgaagaatcctaccgtcgacggaatcaccgtgatagaccttgagcccatctcatacgaccccaagttcgagaagcaacttggtcaggtcatgctcctagttctctgcgctggccagctcctactgatgcgcaccacctgggccttctgtgaagtgttgacgctggctaccgggcccatcttgacactctgggaggggaaccccgggcggttctggaatactacgatcgccgtgagcaccgcaaacatcttccgtggttcctatttggcgggagccggcctcgcgttcagtttaatcaagaacacccaaacaccccggcgtggaacggggactaccggcgagacactcggcgagaagtggaagcggcagttgaactctctggaccgcaaggagtttgaggaatacaaacggtctggcatattggaggtggaccgcaccgaggcgaagtccgcccttaaagacggcagcaagatcaagtacgccgtatcccgggggacaagcaagatccgctggatcgtcgagcgcggcatggtgaagccgaagggcaaagtggtggacctcggctgtggccggggcgggtggtcctactacatggccacactaaagaacgtcaccgaagtaaaggggtacaccaagggcggtcccggccatgaagaacccataccgatggcgacatacgggtggaacttggtcaagttgcactcaggcgtcgatgttttctataagccaacagaacaggtggatacactgctgtgtgatattggcgagtcaagcagcaaccctaccatagaggagggccggacgctacgcgtcctgaaaatggtggaaccctggctgagtagcaagcccgagttttgcatcaaggtgctcaacccttacatgccgacagtgatcgaggagctagaaaaactgcagcgtaagcatggtgggagcctagtgcgctgcccattgtctagaaattccacgcacgagatgtactgggtatctggagtatccgggaacatagtctcgtctgtcaacaccacgtcaaagatgttactcaacagattcacgacccgctaccggaagcccacctacgagaaagacgccgacctcggtgcaggcacaaggagcgtaagtaccgaaacggagaagccagacatggccatcatcggtcggcgcttgcaacggcttcaggaggagcataaggagacctggcattacgaccaagaaaacccctatcgaacgtgggcgtaccacggctcgtacgaagccccatctacgggcagcgccagctccatggtgaacggcgtcgtgaagctgctaaccaaaccgtgggacgtgatccccatggtcacacagctggccatgaccgacacaaccccctttggccagcaacgggtgttcaaagagaaggttgacactcggaccccacagcctaagccggggacccgtatgatcatgaccaccactgccaactggctctgggcgctcctcggcaagaaaaagaacccacgattgtgcacgcgggaagagttcatcagcaaggtacgctctaacgccgccatcggggccgttttccaggaggagcagggctggacttccgccagtgaggcagttaacgattctcgcttctgggaacttgtcgacaaggagcgcgccttgcatcaagaggggaagtgcgagtcctgcgtatacaacatgatgggcaagcgggagaagaagctcggcgagttcgggcgcgccaagggcagtcgtgccatttggtacatgtggttgggagcccgattcctggagttcgaggccctcggcttcctgaatgaggaccattggtttgggcgggagaacagctggagcggcgtcgagggcgagggtctgcaccggttagggtacattttggaggacatcgacaagaaggacggggatctgatttacgccgacgacacagcaggctgggacacccgaatcactgaagacgatctgctgaatgaggaactgatcactgagcagatggctccacaccataaaattttagcgaaagccatcttcaagctgacgtaccagaacaaggtggtcaaggtacttcggccgaccccaaaaggtgcagtcatggacatcataagccgcaaggaccagcggggctccggacaggtgggtacgtacggcctcaacaccttcacgaacatggaggtgcaactaatacgccagatggaggccgagggggttatcacccgagatgacatgcacaatcccaaaggcctcaaggagcgcgtggaaaagtggctcaaggagtgcggtgtggatcgtctgaagcgtatggctatcagcggagacgactgcgtagtgaaacccctcgatgagcgattcagcacgagcctcctgttcctgaacgacatgggcaaagtccgcaaggacatcccgcagtgggaaccctccaagggttggaagaactggcaggaggtgccgttctgcagccaccatttccataagatcttcatgaaagacggcaggtccttggtggtgccgtgccgaaaccaggacgagttgatcggtcgggctcgcatctcccagggcgcaggatggtccctccgggaaaccgcctgcctcgggaaggcctacgcccaaatgtggagccttatgtacttccaccgacgggacctgaggctcgctagcatggcgatctgctccgccgtccctaccgagtggttccccaccagtcgcacgacctggagcattcacgcccaccaccagtggatgactacagaggatatgctcaaggtgtggaaccgagtgtggatcgaggacaaccccaacatgaccgacaagacccccgtccacagctgggaggacatcccgtacctgggcaagcgtgaagatctttggtgtggttcactcattggcctgagctctcgggcaacctgggcgaagaatattcacaccgccataacgcaggtacgaaacctcatcgggaaggaggagtacgtggactacatgcccgttatgaagcggtatagcgcccccttcgagtccgagggcgtattataa

SEQ ID NO: 26228 - RNA, 9867 nt, synthetic construct
  misc_feature 1..9867: note = derived and/or modified CDS sequence (opt11) from DENV-4__FJ024476__SS-prME
  source 1..9867: mol_type = other RNA
tccaccataactttgctctgcctaatccccactgttatggccttccacctgtccacccgggacggtgagccactcatgattgtagccaagcatgagcggggccgtcccctgctgttcaagaccaccgagggcatcaataagtgcaccctaatcgcgatggatttgggagagatgtgtgaggacaccgttacctacaagtgcccgctgctcgtgaacaccgagccagaagacatcgactgctggtgcaacctgaccgccacctgggttatgtacgggacctgcacccagagcggggagcggcgcagagagaagcgctccgtggccttgaccccgcactcgggcatgggtctcgagacccgagcagaaacttggatgtccagcgagggggcctggaagcatgcacaacgcgtggagtcctggatcctgcggaatcccggcttcgccttgctcgccgggtttatggcctatatgatcggccagactgggatccagcgaactgtattcttcgtgctcatgatgctggtggctccctcgtacggcatgcggtgcgtcggtgtggggaaccgcgacttcgtggagggtgtctccggcggagcctgggtggatctcgtactggagcacggcgggtgtgtcacgaccatggcccagggcaagccgaccctggatttcgagctcacaaagaccaccgccaaagaggtggccttacttcggacctactgcatcgaggccagcatttccaacataaccacagccactcgctgcccgacccagggggagccctacctcaaggaggagcaggaccagcaatatatctgtcgacgcgacgtggtagaccggggctgggggaacggctgtggtctgttcgggaagggcggtgtggtgacgtgcgccaagttctcatgctccggcaaaataaccgggaacctggtccagattgagaacttagagtacaccgtggtggttaccgtgcacaacggcgacacgcacgcagttggcaatgacaccagtaaccacggcgtcaccgccatgatcaccccgcggtccccgtccgtagaagtcaagctgccggactatggcgagctgaccttggactgcgagccgcggtccggtattgacttcaacgagatgattctgatgaagatgaagaagaagacctggttagtgcacaagcagtggtttcttgacttacccctgccatggaccgcgggtgccgacacctctgaggtgcactggaactacaaagaacgcatggtcacctttaaggtgccgcacgctaagcggcaggacgtaacggtcctcggatcccaggagggcgccatgcacagcgccctggcgggcgccaccgaagtggacagcggggacggcaaccatatgttcgccgggcacctgaaatgtaaggtgcgcatggagaagctccgcatcaagggcatgtcctacaccatgtgcagtggtaagttctccatcgacaaggagatggccgagacccagcacgggacgaccgtcgtcaaggtgaagtacgagggcgctggggcgccttgcaaggtgcccatcgagatcagagacgtaaacaaggagaaggtggtagggcggatcataagctccactcccctggcggagaacaccaacagcgtgacgaatatcgagttagagcctcccttcggggactcctacatcgttatcggcgtcggtaacagcgctctcacgctacactggttccggaaaggctccagcattggcaaaatgttcgagtcgacttatcgcggcgccaagcggatggcgatcttaggcgagaccgcctgggatttcgggtcggtgggcggcctcttcacgtccctaggaaaggccgttcaccaggtgttcggatctgtgtacacaaccatgtttggaggcgtgtcctggatgatccgcatccttatcgggctcctggtactgtggattggcaccaactctcgtaacacgtccatggccatgacctgcatcgcagtcggaggtataaccttgttcctcggcttcaccgtgcaggcggacatgggatgcgtcgtaagctggtcgggcaaagagctgaaatgcgggagcggcatcttcgtggtagacaacgtgcacacatggaccgagcagtataagttccagcccgagagccccgccaggctggcctccgccatcctcaacgcccacaaggacggtgtgtgcgggatccggagcaccacacgcctggagaacgtgatgtggaagcagataaccaacgagctgaactacgtgctctgggagggtgggcacgacctgaccgtggtcgccggcgacgtaaagggagtgctgacaaaggggaagcgggcactcacgccgcccgtctccgatctgaaatatagctggaagacgtggggtaaggcccggatcttcacccccgaggcccggaactccacctttctgatcgacgggcccgacaccagcgagtgcccaaacgagcgccgagcctggaattcccttgaggtggaggattacggcttcgggatgttcacgaccaacatctggatgaagttccgcgagggcagcagcgaggtttgtgaccatagactgatgagcgcggccattaaagaccagaaggctgtccatgccgacatgggctactggatagagtccagcaagaatcagacctggcagatcgagcgcgcgagtttaatagaggtgaagacgtgcctctggcccaagacccacaccctgtggtcgaacggggtgctggagagccagatgctcatccccaagagctacgccggcccgttttcgcaacacaactaccggcaagggtacgctacccagacgatgggcccgtggcatctggggaagctggagatcggcttcggcgaatgccccgggaccaccgtcacaatccaagaggactgcgaccaccgaggcccgtctctcagaaccaccacggccagcggcaagctggtgacacagtggtgctgccggagttgcactatgcctcctcttcggttcctcggagaggacgggtgctggtacggcatggagatacggcccttatcagaacgcgaagagaacatggtgaagtcccaggtgaccgccggccaggggacgagcgagacattcagcatgggtctgctttgccttaccctgttcgtggaggaatgcctccggcgccgtgtcactcgtaaacacatgatactggtggtggtaatcacgctgtgcgcgatcattctcgggggcctgacctggatggacctgctccgggccctgatcatgctgggcgacaccatgtctgggcgcatcggcgggcagattcacctagccatcatggccgtgttcaagatgtcccccggttacgttctgggggtcttcctccggaagctcaccagccgcgagaccgccttgatggtgatcgggatggcgatgaccacggtgctgtccattccacacgacttgatggagctgatcgacggcatcagtctggggctcatcctgctaaagatcgtgactcagtttgacaacacccaggtgggcaccttggccttatcccttaccttcatccggagcaccatgcccctcgtgatggcctggcgcacgatcatggccgtcctgttcgtggtgaccttgatccccctctgcaggacctcctgcctgcaaaagcaatctcattgggtcgagatcaccgcgctaatcctcggggcgcaagccctgcctgtgtacctgatgacgctaatgaagggagcctccaggcggagctggccgctgaacgagggtatcatggccgtgggcctggtctccctcctgggcagcgcgctgctgaagaacgacgtgcccctagccggccccatggtagccggcgggctgctcttggccgcctatgtcatgtccggaagcagcgcggatctgtccctcgagaaggctgcgaacgtgcagtgggatgaaatggctgacatcaccggcagctcccccatcatcgaggtgaaacaggacgaggacggcagcttttccattcgcgacgtagaggagaccaatatgattacgctgttagtgaagttagcccttatcactgtgagcggtctgtacccgctcgcaatccccgtgaccatgactctgtggtacatgtggcaggtcaagacacagcgatccggcgccctgtgggacgtgcccagtcccgccgccacccagaaggccgctctctccgagggcgtatacaggatcatgcagcggggcctgttcggcaagacacaggtcggtgtgggcatccacatggagggggtcttccataccatgtggcatgtgaccagagggagcgtgatctgccatgagacgggccgcctggagccgtcctgggccgacgtacggaacgacatgataagttacggggggggctggaggctcggcgacaaatgggacaaggaagaggatgtccaggtcctggccatcgagcccggtaaaaaccccaaacatgtccagacgaagcccgggctgttcaaaacactcaccggcgagatcggggcggtgaccctggacttcaaaccgggcacgtccggctcacccataatcaaccggaaggggaaagtgatcggcctctacggcaacggcgtcgtgactaagtccggggactacgttagtgccatcacccaggctgagcgcattggcgagccagactacgaagttgacgaggatatcttccggaagaagcgcctcaccatcatggacctgcaccctggagccggaaagactaaacggatcctgccctccatcgtacgcgaggcactgaaacggagactccgtaccctgatcctggcccccaccagggtggtcgcggccgagatggaagaggcattacgaggactgcccatacgctaccagactccggccgtaaagagcgagcacacgggtagagagattgtggacctgatgtgccacgcgaccttcacaacccgtctcttgagtagtacgagagtccccaactacaacctgatcgtgatggacgaagcgcacttcaccgacccctcgtccgtcgccgcacgcggctacatcagcacccgggtggagatgggggaggccgccgcgatctttatgactgcaacgcccccgggcgctaccgaccccttccctcaaagcaactcccccatcgaggacattgagcgagagattccggagagaagctggaacactggttttgactggatcactgactaccaggggaaaacggtgtggttcgtaccaagcatcaaggccggcaacgatatagccaattgtttgcggaagtccgggaagaaggtggtgcagcttagccgcaagaccttcgacacagagtacccgaagaccaagcttactgactgggattttgtcgtgactaccgacatctccgagatgggcgcgaacttccgggccgggagagtgatcgacccccggcgctgcctcaaaccggtgattctaactgacggccccgaacgggtgattctcgccggtccgatccctgtgacgccggccagcgcggcccagcgcagggggcgcatcggccgtaaccccgcccaagaagacgaccagtacgtcttctcaggcgaccctcttaagaacgacgaggatcacgcacattggaccgaggccaagatgctgctggataatatatacacccccgaagggatcattccaaccttattcggtccggagcgcgaaaagacgcaggcgatcgacggagaattccggctgcgcggcgagcagcgtaagaccttcgtggagctgatgcgcagaggcgatctccccgtgtggctgagctacaaagttgcctccgcggggatcagctacaaggaccgcgagtggtgtttcaccggggaacggaataaccagattctggaggagaacatggaggtcgaaatctggacccgggagggcgagaagaaaaagctccgcccacgatggctggacgcccgggtgtatgccgacccgatggcgctgaaggattttaaggagttcgcctcaggccgcaagagcatcacattagatatccttaccgagatcgccagcctgcccacgtacctcagctcccgcgctaagctggccctggacaacatcgtcatgctccacaccaccgagcgcggcggtcgtgcgtatcagcatgctttgaacgagttgccagagagcctcgagacgctgatgctggtggccctcctgggggctatgacagctgggatcttcctgttcttcatgcagggcaagggcatcggcaaactctctatgggactgatcaccatcgctgttgcttccggcctgttgtgggtcgccgagatccagccgcaatggatcgccgcgagcatcatcctggagttcttcctgatggtgctcttaatccccgagcccgaaaagcagcggacgccccaggacaatcagttgatttacgtgatcctcacgatcttaaccattatcgggctgatcgccgccaacgagatgggtctcatagagaagaccaagaccgacttcggcttttaccaagtcaagaccgagaccaccatcctggatgtggacctccggccggcgtccgcctggacgctctacgcggtagccacgaccatcttgacccccatgctgcggcacaccatcgagaacacgagcgccaacctctccctggcagctatcgcgaaccaggccgcggtcctgatgggcctgggcaaagggtggccgctgcaccgcatggacctgggcgtgccactcctggccatggggtgctacagccaggtgaaccctaccaccctgactgcctccctcgttatgctgctggtgcactacgcaattatcggccccggcctccaggccaaagccacgcgggaggcccagaagagaaccgcggccgggatcatgaagaaccccaccgtagacggtatcaccgtcattgatctggagcccatcagctacgacccgaagttcgagaaacagctgggccaggtaatgctcctggttctgtgcgctggccagttactgctgatgaggacaacctgggccttttgcgaggtactcacgctggccaccggacccattctgactctctgggaggggaaccccggccgcttctggaacaccaccatagcggtctcgaccgctaacatcttccgtgggagctaccttgccggcgccggcctggctttctccctcatcaagaacgcgcagacgccccgtcggggcaccgggaccaccggcgaaacgctgggcgagaagtggaagcgccagctgaactcgctcgacagaaaggagttcgaggagtacaagcgcagtgggatcctggaggttgaccggaccgaggccaaaagcgcgctgaaagatggttccaaaatcaaacacgccgtcagccgagggtcctctaagatccgctggatcgtggagcggggcatggtaaagccgaaagggaaggtcgtagacctcggttgcggtcgcgggggctggtcctactacatggccactctaaagaacgtgaccgaggtcaaggggtacaccaagggcgggcccgggcatgaggagcccatcccgatggcgacgtacggatggaacctagtgaagctccactcgggggtggacgtattctacaagccgacagagcaggtcgacaccctgctgtgcgatatcggagaatcaagtagcaaccccacaatcgaggaggggcggacacttcgcgtgctgaagatggtcgagccctggctgtcctcaaagcccgagttctgcatcaaggtgctgaatccgtacatgcccaccgtcatcgaggagcttgagaagctgcagcggaagcatggcggcaacctggtgcgctgtcccctctcccggaactctacccacgagatgtactgggtctccggggctagcggcaacatcgtgtctagcgtaaacaccacgagtaagatgctgctgaaccgcttcaccacgcggcaccgcaagcccacctacgagaaagacgtggacctcggagccggcacgcggagcgtctccaccgagacagagaagccggacatgaccatcatcggccgccgtctgcagcgcctgcaggaagagcataaagagacgtggcactacgaccaggagaatccctatcggacctgggcataccacggctcatacgaagcgcccagtaccggcagtgcctccagtatggtgaatggggtggtgaagttgttgacaaagccgtgggacgtcatccccatggtgacgcagctggccatgaccgacaccacccccttcggccaacagcgcgtcttcaaagagaaggttgacactcggacgccacaaccgaagcccggaacgcgcatggtgatgacaaccaccgcgaactggctctgggcgctgctgggcaagaaaaagaacccgcggctctgcacccgcgaagagttcatctccaaggtccggagcaacgccgccatcggggccgtgttccaggaggagcagggctggaccagtgcatcagaggcagtgaacgactcacgcttctgggagctagtggacaaggagcgcgcgctgcaccaggagggaaagtgcgagagctgcgtgtataacatgatggggaaacgggagaagaagttaggagagttcgggcgcgctaagggaagccgggccatctggtacatgtggctcggcgctcggttcctggagttcgaggcgttaggcttcctcaacgaagaccactggttcggccgggagaattcctggagcggggtagagggcgaggggctgcaccgcctcggttacatactggaagagatcgacaagaaggacggagacctgatgtacgcggacgatacggccggatgggacacccggataacagaggacgacctccagaacgaggagctgattaccgagcaaatggcgccccatcacaagattctggcaaaagctatcttcaagctcacgtaccaaaacaaggtcgtgaaggtgctgcgcccgactccccgtggcgccgtaatggacatcatcagtcgcaaggaccagcgggggagcggccaggtggggacatacgggttaaacaccttcacaaatatggaggtgcagcttatccgccagatggaggccgagggcgtcatcactcaggacgacatgcagaaccccaaaggtctgcgagagcgcgtggagaagtggttgaaggagtgcggtgtggacaggctcaagcgtatggccatctccggggacgactgcgtagttaagccgctcgatgagcgtttcggcacctctctcctcttcttaaatgacatggggaaggtgcgcaaagacattccgcagtgggagcccagcaaaggctggaagaactggcaagaggtccccttctgctcgcaccacttccacaagatctttatgaaggatggcaggagtctggtggtgccctgccgcaaccaggacgagcttatcgggcgcgcccggatcagccagggcgcgggttggtcgctgagagaaaccgcatgcctgggcaaggcctacgcgcaaatgtggagcttgatgtatttccaccggcgtgacttacggctggcatcaatggccatttgcagcgccgtgcccaccgagtggttcccaacttcgcgcacaacctggagcattcacgcccaccaccaatggatgactacggaggacatgctgaaggtgtggaatcgggtttggatcgaggacaaccccaacatgaccgataagaccccagtccatagctgggaggacataccgtacctggggaagcgcgaggacctgtggtgcgggagtcttatcggcctgagctcaagggcaacgtgggccaagaacatccacacggcgatcacccaagtgcgcaacctgatcggtaaggaagagtacgtggactacatgcccgtcatgaagcggtacagcgccccatcggagagcgaaggcgtactctga

SEQ ID NO: 26229 - RNA, 9867 nt, synthetic construct
  misc_feature 1..9867: note = derived and/or modified CDS sequence (opt11) from DENV-4__GQ868579__SS-prME
  source 1..9867: mol_type = other RNA
agcaccataaccctgctctgcttgatccccacgattatggccttccacctgtccacccgggacggcgaaccgctcatgatcgtggccaagcacgaacggggtcgacctctgctgttcaagaccaccgaaggcatcaacaagtgcacgctcatagcgatggatctgggggagatgtgtgaggatacagtcacgtacaagtgccccctactgatcaacaccgaacccgaggatatcgattgctggtgcaacctgaccagcacttgggttatgtacggaacctgcacccagtctggggagcgacggcgggagaagcgcagcgttgccctgacgccgcactcgggcatgggtctggagactcgggccgagacatggatgtcctccgagggggcctggaagcacgcccagcgcgtcgagagctggattctgcggaaccctggcttcgcgttactcgccgggttcatggcctacatgatcgggcagactgggatacagcggacagtgttcttcattctgatgatgctggtggccccctcatacggcatgcggtgcgtcggggtcgggaaccgcgacttcgtggagggcgtcagcgggggcgcgtgggtcgacctcgtcctggagcacggcggttgcgtcaccaccatggcccagggcaagccaaccctggatttcgagctcactaagaccaccgctaaggaagtggccctgctgcggacgtactgtatcgaggccctcatctccaacatcacgaccgcgacacgctgcccgacccagggggaaccctacctcaaggaggagcaggaccaacagtacatctgccggcgcgacgtggtcgatcgagggtgggggaacggctgcgggctgtttgggaagggcggggtggttacgtgcgccaagttcagctgctccggcaagatcaccgggaacctggtccagattgagaacttggagtacacggtggtcgtcaccgttcacaacggcgacacgcatgccgtggggaatgacaccagcaaccacggcgtcacggcgacaatcacgccacgctcacccagcgtggaggtcaaacttccggattacggcgagctcaccctggactgcgagccccggtccgggatcgatttcaacgaaatgatcttaatgaagatgaagaagaagacctggttggttcacaagcagtggttccttgacctgcccctcccctggacggcaggcgcggacaccagcgaggtccactggaactacaaggaacgcatggtcacgttcaaggtgcctcacgccaagcgtcaggatgtgacagtgctgggctcccaggagggtgctatgcatagcgccctggctggcgccactgaggttgacagcggggatggcaaccatatgttcgccgggcacctcaagtgcaaggtccgcatggagaagctgcgcatcaagggcatgtcttacaccatgtgcagcggcaagttcagcatcgacaaggaaatggcggagacacagcacgggacaaccgtcgtgaaggtgaagtacgagggcgccggggccccctgcaaggtccccattgaaatcagagacgtgaataaggagaaagtggtgggccgcgtgatcagctccacacccctggcagagaacactaactcggtgacgaatatcgagcttgagccgcccttcggggactcctacattgtcatcggcgttggcaacagcgctctaaccctgcattggtttcggaaagggtccagcatagggaagatgttcgaatccacctatcgcggggccaaacggatggctattctcggcgagaccgcctgggacttcgggagcgtgggcgggctgtttacttccctggggaaggccgtccatcaggtgttcggaagcgtgtacactacaatgtttggtggcgtctcctggatgatacgcatactcatcggatttttggtcctctggatcggcaccaacagccggaacacctccatggccatgacctgcatcgccgtgggcgggatcaccctgttcctcggcttcaccgtgcgtgccgacatggggtgcgtggtgagctggtccggccgagagctgaagtgtgggagcggcatcttcgtcgtggacaacgtgcacacatggaccgagcagtacaagttccagcccgagtcacccgctcggctggcctccgccatcctcaacgcgcacaaggacggcgtctgcgggatccggtcaaccacgagactggagaacgtgatgtggaagcagatcacaaacgaactgaactatgtgttgtgggagggcggacacgacttaaccgttgtggctggcgacgtcaagggtgtgctgaccaagggcaaaagagcgctcacgccgcccgtgtccgacctgaagtacagctggaagacctggggcaaggccaaaatcttcacccccgaggcccgcaattccacgttccttatcgacgggccggacacgagcgagtgccctaacgagcggcgcgcctggaactccctcgaggtggaggattacggcttcgggatgttcaccaccaacatatggatgaagttcagagagggtagctccgaggtctgcgaccaccgcctgatgagcgcggcgatcaaggatcaaaaggccgtgcatgccgacatgggctactggatcgagtcgtccaagaaccagacctggcagatcgaacgggcatcccttatcgaggtgaaaacgtgtctctggcccaagacccacaccctgtggagcaacggggtcttggagagccaaatgctcatccccaaaagctacgctggtccgttctctcaacacaactaccgccagggatatgcgactcagactgtgggtccctggcacctagggaaactggaaatcgacttcggggaatgccccggcacgaccgtgacaatccaggaagactgcgaccaccgcgggcccagcctccggactacgaccgccagcggaaagctggtgacccagtggtgctgccgctcctgcaccatgccacccctacggttcttgggagaggacggctgctggtacgggatggagatccgaccactgtccgagaaggaagaaaacatggtaaagagccaagtgacggccggccaatcaacctccgagaccttcagcatgggcctcctctgcctgaccctgttcgttgaggagtgcctgagaaggagagtaacccgcaagcacatgatcctggccgtcgtgatcaccctgtgcgcgatcattctcggtggactgacctggatggaccttcttcgggccctgatcatgctgggagacacaatgtccggccgcatcggtgggcagacgcacctagccatcatggccgtcttcaagatgagcccgggctacgtgctgggggtgttcctgcggaagctcacatcacgcgagactgcactgatggtgattggcatggcgatgaccacgaccctgagcatcccgcacgatctcatggagctgatcgacgggatctccctgggcctcatcttactgaagatcgtgacccaatttgacaacactcaagtgggcacgctcgccctgtcgttaaccttcatccggtccactatgagcctcgtaatggcctggcgcaccatcatggccgtgcttttcgtcgtgacactgatccccctctgtcggacgtcctgcctgcagaagcaatctcactgggtggaaattaccgccctgatcttaggggcgcaggccctgcccgtgtacctcatgaccctcatgaagggcgcctcccggcgatcttggcccctaaatgaggggattatggctgtgggcctggtctccctcctggggagtgcgctgctcaagaacgacgtgccgctggccggtccaatggttgccggcgggttactcctagccgcctacgtcatgagcggctcaagcgctgacctaagtctcgagaaggccgctaacgtccagtgggatgagatggccgacatcactgggagctctcccatcatcgaggtgaagcaggacgaggacggctcgttctccatccgcgacgtcgaggagactaacatgatcaccctgctggtgaagctcgccctcatcaccgttagcgggctgtaccccctcgcaatcccggtcacgatgactctgtggtatatgtggcaagtgaagacccaacggtccggcgcactgtgggacgtgccctcccccgccgccacccagaaggccgcgctatccgagggcgtctaccgcatcatgcagcgagggctgtttgggaagacccaggtgggggtaggcatccacatggagggggtcttccacacaatgtggcatgtgaccaggggcagcgtaatttgccacgagaccggccgcttagaaccctcctgggccgacgtccggaacgacatgatcagctatgggggcggctggcgcctcggcgacaaatgggatcgggaggaggacgtgcaggttctggccattgagccgggcaagaatcccaagcacgtccagaccaagcccggtctgttcaagaccctaaccggtgaaatcggggccgtgaccctggacttcaagcccggcacctccggcagcccgataattaacaaaaagggcaaggtgatcggcctgtacgggaacggcgtcgtgacaaagtccggggattatgtaagcgccattacgcaggccgagcgcatcggcgagcccgactacgaagtagatgaggacatcttcaggaaaaagagactcacaatcatggacctgcacccaggggccggcaagaccaagcggatactgccatccattgtgcgcgaggccctaaaaaggcgcctccggacgctgatcctggcccccacccgcgtggtcgcggccgaaatggaggaagcgctccgcggcctgcccatccgctaccaaacgccagccgtaaagagcgagcacaccgggcgagagatcgtggacctgatgtgccacgccacgttcaccacccgcctgctcagttcgacgcgggttcccaactacaacctcatcgttatggatgaggcgcacttcacggaccccagctccgtggcagcccgcggctacataagcacccgtgtcgagatgggggaagccgccgccatatttatgaccgccaccccaccgggcgccaccgacccgttcccccaatccaacagccctatcgaggatatcgagcgcgagattcccgagagatcttggaataccgggtttgactggatcaccgactaccagggcaagaccgtgtggttcgtcccgagcatcaaggccggcaacgacatcgccaattgtctccggaaatccgggaagaaggtgattcagctgtcccgcaagaccttcgacaccgagtacccgaagaccaaacttaccgactgggacttcgtggtaacaaccgacatctccgagatgggtgcgaacttccgggcgggcagagtaatagacccccgtagatgcctcaagcccgttattcttaccgacggcccggagcgggtcattctggcgggtcccatcccggtgacgcccgcatcagctgcccaacgccggggccgcatcgggcggaatccagcccaggaggacgaccagtacgtgttctcaggggacccccttaagaacgacgaggaccacgcccactggacagaggccaagatgctgctggacaatatatacacccccgagggcattatccccaccctctttgggccggagcgcgagaagacccaggcgatcgatggcgagttccggctgcgcggcgaacagcggaagacgttcgtcgagctgatgcgccgaggggacctccccgtgtggctgtcgtacaaggtggcctccgccggaatctcatacaaggaccgggagtggtgcttcaccggagagcggaacaaccagatcttagaggagaacatggaggtcgagatctggacacgcgagggggagaagaagaagctccggcccaggtggctggacgcccgagtgtacgccgaccccatggccctgaaggatttcaaggagttcgcctccgggcgtaagtcgatcaccttagacatcctgaccgagatcgcatccctgcctacgtacttgagcagccgcgccaaacttgccctggacaacatcgtgatgctccacactacggagcggggcggcagggcgtaccagcacgccctgaatgagctgcctgagtctttagagaccctgatgcttgtcgcattactgggggccatgacggcgggcaccttcctgttcttcatgcaggggaagggcatagggaagttatccatgggcctgatcaccatcgctatggcctccggcctgctctggatcgctgagatccagccacagtggatcgccgcgagcatcatccttgagttctttctgatggtgctcttgatcccggagcccgagaagcagagaaccccgcaagacaaccaactgatctacgtcatcctcactattctagccatcatcgggctgatagccgccaacgagatgggcctcattgagaagaccaaaaccgatttcgggttttaccaggtcaagaccgagaccaccatcctggacgtggacctgcgccccgcctccgcttggacgctctacgccgtggccaccacaattctgactccgatgcttcgccacaccatcgagaatacaagtgccaacctctccttggccgcaattgcaaaccaggctgccgtcctgatgggcctcggtaagggctggccactgcaccgcatggacctcggcgtgcccctgttggcaatggggtgctacagccaggttaaccccacaacgctgaccgcgtccctcgtcatgctgctggtgcactacgccatcatcggccccggtctccaggccaaggccacccgggaggcgcaaaagcgcacggccgcaggcatcatgaaaaatcccaccgtggacggtatcaccgtcatcgacttagagcctatctcatatgatcccaagtttgagaaacaacttggacaggtgatgctcctggtactgtgtgccggacagcttctgctcatgcggacgacgtgggccttctgcgaggtcctcacgctggcgaccgggccgatcctgaccctttgggaaggaaaccccggccgattctggaacacgaccatcgccgtgagtactgccaacatcttccgaggcagctacctggccggagccgggctggcgttctccctgatcaagaacgcccaggcaccccgccggggcacaggtaccaccggcgagactctgggcgagaagtggaaacgccagctgaacagcctcgaccggaaggagttcgaagagtacaaacgctccggtatcctggaggtggaccgaaccgaggccaagagtgccctgaaggatggcagtaagatcaaacacgcggttagccgcgggtcctcgaagattcgctggatcgtggagcggggcatggtgaagccaaaggggaaggtcgtggacctcggctgtggaaggggcgggtggtcctactacatggcaaccctgaagaacgtgacggaagtcaagggatacaccaagggcgggccgggccacgaggagcccatccccatggcgacctacgggtggaacctggtgaaacttcactccggggtggacgtcttctacaagcccaccgagcaagtggacacgttactgtgcgacatcggcgaaagcagcagcaacccgaccattgaggaggggcggaccctccgcgtgctaaagatggtcgagccctggctgtctagcaaacccgagttctgcatcaaggtgctgaacccctatatgccgaccgtgatcgaggagttggagaaactgcagcgtaaacacggcgggaacctggtgcgctgccccctctcccggaactcgacgcatgaaatgtattgggtgtccggtgccagcgggaacatcgtgtcctccgtcaataccacctccaagatgctgttgaaccgctttaccacgcggcaccgcaagcctacctacgagaaggacgtcgatctcggagcgggcacccgcagcgtcagcactgaaactgagaagccagacatgaccataatagggcgccggttacaaaggctgcaggaagaacacaaggagacctggcactacgaccaggagaatccataccgaacgtgggcctaccatggcagctacgaggccccctccacggggagcgcctccagcatggtgaacggcgtagtcaagttattgaccaagccttgggacgtgatcccgatggtgacccagctggcgatgaccgacacaacccccttcggtcagcagcgcgtctttaaggagaaggtggacacccggacaccccagcccaagccggggactcgcatggttatgactacaaccgcgaattggctctgggccctgctgggcaagaagaaaagcccccggctctgcacgcgggaggagtttatctcaaaggtccggagcaacgccgcaatcggggcggtgttccaggaggagcaaggatggacctcggcgagcgaagccgtgaatgactcccgcttttgggagctggtcgacaaggagcgtgcactgcaccaagaagggaagtgcgagagctgtgtgtacaacatgatgggtaagcgtgagaaaaagttaggcgagttcggtcgcgccaagggctcccgggcgatctggtacatgtggctgggtgcgcgcttcttggagttcgaggcactcggttttctgaacgaggaccactggttcgggcgggagaacagctggtccggcgtggagggggaggggttgcaccgtctcggctacatcctggaggaaatagacaagaaggacggggacctgatgtacgctgacgacaccgccggctgggacacccggatcaccgaggacgacttacaaaacgaggaactgatcaccgagcagatggcgccccaccacaagatactggccaaggccatctttaagctcacctaccagaacaaagtcgtcaaagtgctgcgccccacccctagaggggccgtcatggacataattagcagaaaggatcagcgggggtccggccaggtggggacctacggcctgaacacgttcactaatatggaggtacaactcatccgccagatggaagccgagggggtcattacccaggatgacatgcagaaccccaagggtctgaaggagcgggtggaaaactggctgcgcgagtgtggtgtggacagactcaaacgcatggcgatcagcggggacgattgtgtagtgaaacctttggacgagcggttcggcacctcccttctgttcctgaacgacatggggaaagtgcgcaaggatatcccacagtgggaaccgagcaagggctggaagaactggcaggaggtccccttctgctcccaccactttcataagatcttcatgaaggacgggcgtagcctggtagtgccctgccggaatcaggacgagttaatcggcagagcccggatctcccagggcgccgggtggagcctccgcgagacggcctgcttgggcaaggcctacgcgcagatgtggtcgctcatgtacttccaccggcgagacctgaggctggcctcaatggccatatgcagcgccgtacccaccgagtggttcccgacgagtcgcaccacatggagcatacacgcgcaccatcaatggatgaccaccgaagacatgctcaaagtgtggaaccgggtatggatcgaggacaatcctaatatgatcgacaaaactccagtacactcctgggaggacattccctacctggggaagcgagaggacttatggtgcggcagccttattgggctgtccagccgagcgacgtgggccaagaacatccacaccgccatcacccaggtgaggaacctgatcggcaaggaagagtacgtggactacatgccggtcatgaagcggtactccgccccctcggagtcagagggcgttctctga

SEQ ID NO: 26230 - RNA, 9867 nt, synthetic construct
  misc_feature 1..9867: note = derived and/or modified CDS sequence (opt11) from DENV-4__GQ868580__SS-prME
  source 1..9867: mol_type = other RNA
agcaccatcaccctgctctgcctgatacccacgatcatggcgttccacctctccacccgcgacggcgagccattaatgatcgtggccaagcacgagcgtgggcgcccactgctgttcaagaccaccgagggcataaacaaatgtacgctgatcgcgatggacctgggggagatgtgcgaggacaccgtgacctacaagtgtcccctgttaatcaacactgagcccgaggacatagactgctggtgcaacctgacgagcacctgggtgatgtacggcacgtgcacccaatccggggagcggcgccgggagaagcgcagcgtggccctgacgccgcactccggaatgggccttgagacccgggcagagacgtggatgagctcggagggggcctggaagcatgcccaacgcgttgagagctggatcctgcggaaccccgggttcgcccttctcgccgggttcatggcctacatgataggccagaccgggatccaacgcacggtgttcttcgtgttaatgatgctcgtcgccccctcatacggaatgcggtgcgtgggggtggggaaccgcgattttgtcgagggcgtgagcgggggcgcatgggtggaccttgtcctggagcatggcgggtgtgtgactactatggcccagggcaagcccaccctggactttgagttgactaagaccaccgcaaaagaagtcgccctgctgcggacctactgcatcgaagccctcatctccaacatcacgacggcgacccgctgtccgacccaaggggaaccctacctgaaggaagaacaagaccagcagtatatatgtcggagggacgtcgtggatcggggctggggcaacggctgtggcctgttcgggaagggcggggtggtcacgtgtgccaagttcagctgctccggcaagatcaccgggaacctcgtgcaaatcgaaaacctggagtacaccgtggtggtgaccgtgcacaacggcgatactcacgccgtcggcaacgacacctccaaccatggagtgaccgctacgatcactccccgctcgcccagcgtcgaggtgaagctaccggactacggcgaattgaccctcgactgtgaaccgcgaagtgggatcgacttcaacgagatgattctgatgaagatgaagaagaagacttggctcgtgcacaagcagtggttcctggacttgcccctcccctggactgccggcgcagacaccagcgaggtgcactggaactataaggagcgcatggtgacgttcaaggtgccgcacgccaagcgacaggatgtcaccgtgctggggtcccaggagggcgccatgcactctgccctggccggcgcgaccgaggtggatagtggcgacgggaaccacatgttcgcgggccacctcaagtgcaaggtccgcatggagaagctgcgcatcaagggcatgagctataccatgtgctccgggaagttctctatcgacaaggaaatggccgagacgcaacacggcaccaccgtggtgaaggtcaagtacgagggcgcgggggccccctgcaaggtgcccattgaaatccgcgacgttaacaaggagaaggtcgtagggcgcatcatcagtagtacacccctagcggagaacacgaactccgtgaccaacatcgagctcgagccgcccttcggggactcctacatcgtcatcggtgttggcaacagcgctctgactcttcactggtttcggaaggggtcatcaatcggtaagatgttcgagtctacatatcggggcgcaaagcgtatggccatcctcggcgagacagcgtgggacttcgggagcgtagggggcctgttcacatccctggggaaggccgtccaccaagtgttcggcagcgtgtatactaccatgtttggaggcgtctcttggatgatccgcatcctaatagggtttctggtgctgtggatcgggacaaactcacggaatacctccatggccatgacatgcatagccgtgggcgggatcaccctgtttctcggcttcaccgtccaggccgacatgggctgtgtcgtgtcctggtccgggcgcgaactgaagtgtgggagcggcatcttcgtcgtggacaacgtacatacctggacagagcaatacaagttccagcccgaaagccccgctcggctggcgtcggcgatcctcaacgcccacaaggatggtgtctgcgggatcaggagcactacgcggctggagaatgtcatgtggaagcagatcacgaacgagctgaattatgtgttgtgggaaggcggccacgatctgaccgtggtggccggcgacgttaaaggcgtcctgaccaaggggaagcgcgcgctcacgccgcccgtgtccgaccttaagtatagctggaagacctggggcaaggcaaaaattttcacccccgaggcccggaactccacgttcctgatcgacggtcctgacacgagcgagtgcccgaacgaacgacgggcctggaactccctagaagtggaggactacggcttcggcatgttcaccactaacatttggatgaagttccgcgagggcagctccgaagtctgtgaccaccggctaatgagcgccgcgatcaaggaccaaaaggcagttcacgccgacatgggttactggatagagtccagcaagaaccaaacctggcaaatcgagcgggcctccttgatcgaggtgaaaacgtgcctctggcccaagacccacacgctgtggagcaacggggtcctggagtcccaaatgctcatacccaaatcttacgcgggccccttcagtcagcacaactaccgacagggatacgccacccagaccgtgggcccctggcacctggggaagctggagatcgacttcggagagtgtccgggtacaactgtgacgatacaggaggactgcgaccacagggggcccagcctccgcactacgacggcctcgggtaagctggtcacccagtggtgctgtcggtcctgtaccatgccgccactgcgcttcctcggcgaggacggctgctggtatgggatggaaatccggcccctgaacgagaaggaggagaatatggttaagtctcaagtgacggcaggccagtccacgagcgaaaccttctccatggggcttctctgcctgacgctgttcgtcgaagagtgcttaagacgcagagtcacgcggaaacacatgatcttagccgtcgtcattacgctgtgcgcgatcatcctcggaggccttacctggatggacctgctccgcgccctgatcatgctcggggacacaatgagcggcaggatcggcgggcagacacatctcgccatcatggccgtgtttaaaatgtcgcccggttatgtcctgggggtgttcctgcgcaagctcaccagccgggagacagcgctgatggttattggcatggcgatgacgacaacgttctccatccctcacgacctcatggagctcatcgatgggataagcctgggcctgatcctcctgaagatcgtcacccaattcgataacacccaggtgggcacgctggccctctccttaaccttcattcgctcgaccatgagtctcgtcatggcgtggcgtaccatcatggccgtgcttttcgtggtaacgctgatccctctgtgtcgcaccagctgcctccaaaagcaaagtcactgggtcgagattaccgcactgatactgggggcgcaagccctgccagtgtatctgatgaccttaatgaaaggcgcgtcacggagatcgtggcccctcaacgaggggatcatggcagttggcttggtcagcttgttgggttccgcgctgctgaaaaacgacgtgccactcgccgggcccatggtggccggcgggcttctgctcgccgcatatgtcatgagcggcagctccgcggacctgagcttggagaaggccgccaacgtccagtgggacgagatggccgacattacggggtcctcccccatcattgaggtgaagcaggacgaggatggctcctttagcattcgggacgtcgaggagacaaacatgatcaccctcctggtgaagctggccctcatcaccgtgtcggggttgtaccccttagcgataccggtaacgatgaccctctggtacatgtggcaggtaaagacccaacgcagcggcgccctgtgggacgtaccctcccccgccgctacccagaaggccgcgctgagcgagggagtgtaccggataatgcagcgcgggctcctgggcaagacccaagtgggggtcggcatccacatggagggggtcttccacacaatgtggcacgtgacccggggctccgtcatatgccacgagacaggcagactggagcccagctgggccgacgtccgcaacgacatgatatcttacgggggcgggtggcggcttggcgacaagtgggatcgcgaggaggacgtacaggtgctggcgatcgagccgggcaagaaccccaaacacgtccagaccaagcccgggctattcaaaaccctcaccggcgagatcggggccgtaaccctggatttcaagcccggcaccagcgggtccccgatcatcaaccggaagggcaaagtgattggcctgtacgggaacggtgtcgtaactaagagcggcgactatgtgtcggccataacccaggccgaacgcataggagagccagactatgaggtagacgaggacatcttccggaagaagcgccttaccatcatggacttacatcccggggccggcaagaccaaaaggatcctaccgagcatcgtgcgcgaggccctcaagcgtcgcttgcggactttgatcctggcacccacacgcgtggtcgcggctgaaatggaagaagcgttgaggggcctcccaatacgctatcagacgcccgccgtgaagtccgagcacacaggccgggagatcgtggacttgatgtgccacgcgacgttcaccacccgcctccttagcagcacccgggtaccgaactataacctcatcgtgatggacgaggcgcacttcacggacccctcctctgtggccgcccgcggctacatctccactcgggtagagatgggggaggccgccgccatcttcatgaccgccacgccgcccggtgccaccgacccgttcccccagagcaacagtcccatagaagacatcgaacgagagatacccgagagaagttggaacacagggttcgactggatcaccgactaccagggcaagaccgtctggttcgtcccctccattaaggcaggcaacgacatagccaactgccttaggaaaagcggtaagaaggttatccagctgtccaggaagacattcgacaccgagtaccccaagacaaagctgaccgactgggactttgtggtcacgaccgatatcagcgagatgggggcgaactttcgtgccggtcgcgtaatcgacccccgccgctgcctaaagcccgtgatcttgaccgacggtcccgagcgcgtcattctggccggtccaatccccgtgactcctgcctccgcggcccagagacggggccgtatcggccggaaccctgcccaagaggacgatcagtatgttttcagtggtgaccccctcaagaacgacgaggatcacgcgcactggacggaggccaagatgttgctggacaacatatacaccccagagggtatcatccctaccctcttcgggcccgagcgcgagaagacccaggcgatcgacggcgagttccggttgcgcggcgagcagcggaagaccttcgtagagctgatgcgccggggtgacctccccgtgtggctgtcctacaaggtagcatctgccggcatctcctacaaggatcgcgagtggtgtttcaccggggagcggaataaccaaatcctggaggagaacatggaggttgagatctggacacgagaaggcgagaagaagaaacttaggcccagatggctcgacgcccgcgtgtacgccgatcccatggcgttgaaggactttaaggagttcgccagcgggcggaagtcgatcaccttggacatccttaccgaaatcgccagcctgccgacgtatttgtccagccgggccaagctggctctggacaacatcgtcatgttgcacactaccgaaagaggcgggcgggcgtaccagcacgccctgaacgagttgcccgagagcctcgagacactgatgctcgtagccctccttggggccatgaccgccgggatcttcttgttcttcatgcaggggaagggaatcgggaaactctccatgggcctgatcaccatcgccatggccagcggcctcctctggatagcggagatacagccccaatggatcgcagcgtccatcattctggagtttttcctgatggtgctcctgatcccggagcccgagaagcaacggacaccccaggacaaccagctgatctacgtgatactcaccattttgacgatcatcgggttgatcgccgccaacgaaatgggcctcatcgagaagaccaaaacagacttcgggttctaccaggtcaagaccgaaacgaccatccttgatgtagatctgcgccccgcctcagcgtggacgctctacgcggtagccaccacgatcctgacccccatgttgaggcacaccattgaaaacaccagtgccaacctctctctggccgccatcgccaaccaggccgcggtcctgatgggcctcgggaaaggctggcccttgcaccggatggacttgggggtgccgctcctcgccatggggtgctactcccaggtgaacccaactaccttgacagccagcctcgtcatgttgctggtgcattacgcgatcatcggcccggggctccaggccaaggccacccgtgaagcccagaagcgcacggcggccggcataatgaagaaccccaccgtggacggtatcactgtcatcgacctggagcctatatcctacgaccccaagttcgagaagcagctgggccaggtgatgctcttggtgctgtgcgccggccagttgttactgatgcggaccacgtgggccttctgcgaggtcctaaccctggccaccgggcccattctgaccctctgggagggcaaccccgggcgcttctggaataccaccatcgcggtgagcactgccaacatctttcggggttcttacttggccggtgccgggctggccttctcgctcatcaagaacgcgcagactccccgccggggcacggggacgaccggcgagaccctgggggaaaagtggaagcgccagttaaactccctcgaccggaaggagttcgaggagtacaagcgcagcgggatactagaggttgaccggaccgaagccaaatccgccctgaaagatggcagcaagatcaagcacgccgtctccagggggagctcaaagatacgctggattgtggagaggggaatggtgaaacctaaaggcaaggtcgttgacctcggctgtggccgcggcggctggagctactatatggccacactgaagaacgtgaccgaggtcaaggggtacacaaaaggcgggccggggcacgaggagccaatccccatggcgacctacgggtggaatctggtgaaacttcatagcggcgtggacgtcttctacaagcccacggaacaggtggacacgctgttgtgcgacatcggcgagtccagttccaaccccaccatcgaagaggggcggaccctccgcgtcctgaaaatggtcgaaccctggctgtcgtcaaagccagagttttgtattaaagtgctgaacccctacatgccgacggtgatagaggagctcgagaagctgcagcggaagcacggtggcaatctagtacgctgcccgctcagcagaaattccacccacgaaatgtactgggtgagcggcgccagtggaaacatcgtgagctccgtcaatacgacaagtaaaatgctgttaaaccggttcacgaccaggcatcgtaagcccacgtacgagaaggacgtggatctcggggccggtacccggtcagtcagcacggagacggagaagcccgacatgaccataatcggccgccggctgcagcgcctgcaggaggaacacaaggaaacctggcactacgaccaggagaacccgtaccggacgtgggcctaccacggctcctacgaggcgcccagcaccggttcggccagctccatggtgaacggcgtggtcaagttgctgaccaagccctgggacgtgatcccaatggtgacccagctggctatgacggacacaactccattcggccagcagcgcgttttcaaggagaaggtggacacccggacgccccagccgaagccggggaccaggatggtgatgaccaccacggctaactggctctgggccctgctcggcaagaaaaagtcaccccggctctgcacacgcgaggagttcatcagcaaggtccggtctaacgctgccatcggggcagtgtttcaggaggagcagggttggactagcgcctccgaggccgtgagcgactccaggttctgggagctggtcgacaaggaaagggcgctgcaccaggagggcaagtgtgaaagctgtgtctacaacatgatgggcaagcgggaaaagaagctcggcgagttcgggcgcgccaagggctcccgggccatttggtacatgtggttaggggctcgcttcttggagttcgaggccctcggtttcctgaacgaggaccactggttcgggcgggagaacagctggtccggggtggagggcgaggggctccaccgcctcggctacatccttgaagagatcgacaagaaggatggggatctgatgtacgctgacgacaccgccggctgggacacacgtatcaccgaggacgatcttcagaacgaggaactgattaccgagcagatggccccgcatcataaaatcctggctaaggcgatctttaagctcacctaccagaacaaggtagtaaaggtgttacgccccaccccgaggggcgccgtcatggacatcatcagcaggaaggaccagcgggggagcggacaggtgggaacgtatagcctgaacaccttcactaacatggaggttcagctcatccgccagatggaggccgagggcgtcatcacccaggacgacatgcagaaccccaagggcctgaaagagagggtagaaaactggcttcgcgagtgcggcgttgaccgcctgaagagaatggcgatatcgggcgacgactgcgtcgtgaaacccctggacgaacggttcgggacgtcactactcttcttgaacgacatgggcaaggtgcgtaaggacattccccagtgggagccgtccaaggggtggaagaactggcaagaagtacccttctgcagccatcacttccacaagatcttcatgaaggacgggcgatcactggtggtgccctgtaggaaccaggacgagctaatcgggcgggcccggatcagccagggtgcggggtggagcctgagagagaccgcctgcttggggaaggcttacgcccaaatgtggagtctcatgtacttccaccggcgcgacctgcggctggcgtcgatggctatctgctccgccgtcccgactgagtggttccctaccagccgcaccacctggtccattcacgcccaccaccaatggatgacgacggaagatatgttgaaggtttggaaccgggtctggattgaggacaatccaaacatgattgacaagacgcctgtccacagctgggaggacatcccctacctgggcaaaagggaagatctgtggtgcggatccctcatcgggcttagctcccgggcgacctgggccaagaacatccatactgcgatcacccaggtgcgcaacctgatcgggaaagaggaatatgtagactatatgccggtcatgaagcgatacagcgccccctccgagagcgagggcgtgctctga

SEQ ID NO: 26231 - RNA, 9867 nt, synthetic construct
  misc_feature 1..9867: note = derived and/or modified CDS sequence (opt11) from DENV-4__GQ868583__SS-prME
  source 1..9867: mol_type = other RNA
tcgacgataacgctgctttgtctcatccccaccgtcatggcgtttcatctctcgacgcgggacggggaacccctgatgatcgtagcaaaacacgaaagagggcgcccactactcttcaaaacaacggaaggtataaacaaatgcaccctcatagcaatggatctcggggaaatgtgcgaagatacagtcacgtataaatgccccctgttagtcaatactgaaccagaggacatagactgctggtgcaacctgacgagtacgtgggtcatgtatgggacctgcacccaatcaggggagcgccgacgtgaaaagcgatcggtcgcactgacaccacactcaggcatgggactcgaaacacgcgcagaaacgtggatgtcctcagaaggagcctggaaacatgcccagcgagtcgaatcatggatcctgagaaacccggggttcgcgctactcgctgggttcatggcatacatgatcggtcaaactgggatacagcgcacagtgttctttgtactgatgatgctcgtagcgcccagttacggaatgagatgcgttggtgtcggaaaccgcgactttgtagaaggagtgagtggaggcgcatgggtggacttagtactagaacacggagggtgcgtcaccaccatggcccaagggaaacccaccctagacttcgagttgacgaaaacaacggcgaaagaggtagccttactgcggacatactgtattgaagcactgatatcgaacataacgaccgcaacgcgctgcccaacccaaggggaaccgtacctcaaagaagaacaagaccaacaatacatatgccgacgcgacgttgttgataggggatggggcaacggttgtggattattcgggaaaggtggagttgtgacatgcgccaaattctcgtgctccgggaaaattaccgggaacctagtacaaattgagaacctagaatacacggttgtcgtaacagtccacaatggcgatacacacgcagtcggaaatgacaccagtaatcacggtgttacggcgaccatcaccccgcgaagcccaagtgtggaggtaaaattgcctgactacggcgaacttacgctggactgcgagccacgcagcggcatcgacttcaatgagatgatacttatgaaaatgaagaagaaaacctggctcgtccacaaacaatggtttctggacttaccattaccgtggacaaccggagcagacacttcagaggtgcactggaactacaaagagagaatggtaacattcaaagtgccacacgcgaaacggcaagatgtgacagtcctaggttcacaagagggggcaatgcactccgcgctcgcgggcgcaacggaggtcgactcaggagatgggaatcacatgttcgccggacacctaaaatgtaaggtgcgaatggaaaaacttcggataaagggaatgagctacaccatgtgctcgggtaaattctctatagataaggaaatggccgagacacaacacggcacgacagtagtgaaggtgaaatacgaaggagcgggagcaccgtgcaaagtgccaatcgaaataagagacgtaaacaaggagaaagtggtcggaagagtgatctctgcgacgccactggccgaaaatacgaatagtgtaacgaacatagaactggaaccaccgttcggcgacagttatataatgatcggcgtggggaactcggccctgacattgcactggttcagaaagggctcctcaatcggtaagatgttcgaaagcacgtacaggggcgcgaagaggatggcgatccttggcgagactgcctgggacttcgggagtgtaggcgggctatttacttcgcttggcaaggcagttcatcaggtcttcggtagtgtctacaccacaatgttcgggggagtcagctggatgatacgaatcctcatcgggttcctagtactatggataggaaccaactcaaggaatacgtccatggcaatgacctgtatagcagtgggcggcataaccctgttcttaggattcaccgtgcaggccgacatggggtgtgtggtgagttggagcggccgtgagctcaaatgcggtagtggcatattcgtagtagacaatgtacacacgtggacagaacaatacaagttccagccggaaagtccggcccggctagcctcggcaatcctgaacgcccacaaagacggcgtctgcggaatacgcagtactacccgcctagagaatgtgatgtggaagcaaataaccaatgaactcaattatgtattatgggaaggagggcatgacctcacagtagtcgccggtgatgtaaagggggtcctgacaaagggtaagcgcgccctcgcgccacccgcctcggatttaaagtacagctggaaaacctggggaaaagccaagatattcactccggaagcacggaactcaacgttcctaatagacggaccagataccagcgagtgtccgaacgaaaggagagcatggaatagctttgaagttgaagactatggattcggcatgttcacgaccaacatctggatgaaattcagagaagggagttcagaggtatgcgaccatcgcctaatgtctgcagccatcaaagaccagaaagcagtacacgccgacatgggatactggatcgaaagtagcaagaatcagacatggcaaatagaacgggcatcgctaatagaggtgaaaacgtgcctttggccgaaaacgcacacgctgtggtcaaacggcgtgctagaatcccaaatgctgatcccaaaatcgtacgcagggcccttcagccaacacaactatcgccaaggttatgcgacccaaacagtaggtccttggcacctcggcaaactcgaaatagacttcggagaatgtccgggcactacagtaacaatccaggaagactgcgatcatcgaggaccaagcctacggacaaccaccgcaagcggaaaattagtaacccagtggtgttgccgaagctgcaccatgccgccgctgagattcctcggcgaggatggatgctggtatgggatggagatacgccctctttcggagaaggaagagaacatggtgaaatcccaagttacagcaggccaaggcaccagcgaaactttttcaatgggattactctgcctgacacttttcgtagaggagtgtcttcggcgtcgggtcacgagaaagcatatgattctagccgtggtaattaccttgtgcgctattatcctgggcggtctaacatggatggacctattacgtgcactgataatgctaggcgacacaatgtcaggacgaataggagggcagacacacctagccataatggctgtcttcaaaatgtcgcccggctatgtcttgggagtattcctgcgcaagctaacgagcagagaaactgccctaatggtgataggcatggccatgacgacaacactaagcataccacacgacctcatggaattgattgacggcatttcgctaggcctaattctcctgaaaatcgtcacacagttcgacaatacacaagttgggacgctcgcactctctctaacgttcatccgatcaacgatgtcattagtgatggcatggaggacaatcatggcagtcttattcgtcgtcacccttataccgttgtgtcgcacttcgtgtctccagaagcaaagccactgggtagagataacagctctaatactgggggcacaggcactcccagtctatttgatgacgttaatgaaaggcgcgagcaggcgatcctggccactcaacgaaggaatcatggcggtgggcttggttagcttattaggctcagccctgctgaaaaacgatgtgcccctcgccggcccaatggtggcaggaggcctgctcctcgccgcctacgtaatgagcggttcaagcgcggacctgtccctcgaaaaggccgctaatgtacagtgggatgagatggccgatataacaggctcgagtccaatcatagaagtaaagcaagacgaagacgggagtttcagtatcagggatgttgaggaaacaaacatgataacgctgcttgtgaagttggccctcatcacagtcagcggcctatacccgctagcgataccagtgacgatgacactatggtacatgtggcaggtcaaaacccaaagatccggggcactatgggacgtgccaagcccagctgcaactcagaaagccgcactaagtgaaggcgtgtacaggataatgcaaagaggcttatttggcaaaacacaggtaggagtgggtatacacatggagggtgtgttccacacaatgtggcacgtaactcgagggagcgtaatctgccacgaaacaggcaggctagaacccagctgggcagacgtaaggaatgatatgatcagctacggaggcgggtggcggctaggggacaagtgggataaagaagaagacgtccaagtactggccatagaacccggcaaaaaccccaaacacgtgcaaaccaagccgggcctgttcaaaacacttacaggggaaataggggccgtaaccttagattttaagccgggcacctccggtagcccaatcatcaatcgcaagggcaaagttataggattatacggaaacggcgtcgtcacaaaaagcggggactatgtaagcgcaatcacacaggcagaacggataggagagccagattatgaagtggatgaggatatctttcgaaagaaacgactcacaatcatggatcttcacccgggagcaggcaagacaaagcgcatactcccgtcaatcgtgagggaggccctgaaacggagattacgcacacttatactcgccccaacccgtgtagtcgcggctgagatggaggaagcactacgcggactccctatccgataccaaactcccgcggtaaagagcgaacataccgggcgagagatcgtagacctcatgtgccacgccacctttacgacaagattactctcgagcacgcgagtcccaaactataacctaattgtaatggacgaggcccacttcacagatccatcatcggttgctgcacgcgggtacatctccacaagagtagagatgggggaagcagcagctatcttcatgaccgccacaccgccaggggccacggaccccttcccacagagcaattcccccatagaggatatcgagcgcgagatccccgagcggagttggaacacagggttcgactggataacagactaccaaggaaagacagtatggttcgtaccgtcaataaaagccgggaatgatattgcgaactgcttaagaaaaagcggcaaaaaggtcatccaactctcccgcaagacgttcgacacagaatacccgaaaaccaagctaacggactgggacttcgtagtaaccacggacatcagcgaaatgggggccaacttccgagcgggtagggtcatcgatccacgaagatgcctgaagcccgtcatcctaacagacggcccagaaagggtgatcctcgcaggcccaataccggtcacccccgcaagcgcagcgcagcgacgcggtcgcataggaagaaaccccgcacaagaagacgaccaatatgttttcagcggcgaccccctaaagaacgatgaagatcacgcacactggacggaagctaaaatgctattagataacatatatacccctgagggcatcataccaacgctattcgggcccgagagggagaaaacacaggctatagacggggagttccgcctgcggggagagcaaaggaagacttttgtcgaactgatgcgacgcggagacctgcccgtctggctgagctataaggtagcaagcgccggcattagctacaaagacagagaatggtgttttacgggagaaaggaacaatcaaatactggaagagaatatggaagtagaaatatggacgagagaaggggagaagaagaaactacgccccaaatggctcgacgcccgggtctacgccgacccgatggcattacaagacttcaaggagttcgcatcaggaagaaaatcaatcaccctggatatcctcacagaaatagcatcgctcccaacatacctcagcagccgggcaaagctcgcactggacaacatagtgatgctacacacaactgagagaggcggccgggcctaccagcatgctctaaacgaactcccggagagtctggagacgctaatgctagtagccctcctgggagcaatgactgcagggatcttcctgtttttcatgcaaggtaaaggcatcggcaaactaagtatgggactcataacaatcgccgtggcatcaggactactatgggtagccgagatccaaccccaatggatagcggcgtccataatacttgagttcttcttaatggtattactcattcctgagcccgagaaacaaaggacaccccaagacaaccaactaatatacgtaatcctgacaattcttacaatcatcggactcattgccgcaaacgaaatgggactaattgagaaaacaaagacagacttcggcttttaccaggttaagacagaaacaacaatactcgacgtcgacctgcgacccgcctccgcctggaccttatacgcggttgcgacaacaatattgacgcctatgctcaggcacaccatcgagaacaccagcgcaaatttgtcgttggcggcaatagccaatcaggcggccgtactaatggggctcgggaagggatggccgcttcacagaatggacctgggtgttcccctccttgctatgggatgctacagccaagtcaaccccactactttaactgcgtccctggtcatgttgctggtccattacgcaatcatcggaccaggccttcaagcaaaggcaacgcgtgaagcccaaaaacggacagcagcggggatcatgaaaaaccccaccgtcgacgggattacagtaattgatctagaaccgatcagctacgaccccaaattcgagaaacaacttggccaagtgatgttgctagtactctgtgcaggccaattactattgatgaggacaacgtgggccttctgcgaagttctaaccctggcgacaggaccaattctaacattgtgggaagggaatccggggcgattctggaacacgacaatagctgtcagtaccgcaaacattttcagaggctcgtacctggcaggcgcgggtctcgcctttagcttaatcaaaaacgcccagacaccccgccgcggcaccggcaccacaggcgaaacgctaggggagaagtggaaacgacagcttaattcgctagaccgaaaagagttcgaagaatacaaacgtagcggcattctagaagtagaccggactgaagcaaagtccgcgttgaaagatgggtctaagattaaacacgcggtgtctcggggatcgagcaagatacgatggatagttgagcgcggaatggtgaagcctaagggaaaagtcgtagaccttggatgcggccgaggcggatggtcctactacatggccacacttaagaatgtcacagaggtcaaaggctacacgaaagggggccccgggcacgaggaacccattccaatggcaacatacggttggaacttagtgaaactccatagtggcgtggacgtgttctacaaaccaacggaacaggtggacacactcttatgtgacataggagagagctctagcaaccccaccatagaagaaggacgtacactccgagtgttaaaaatggtcgagccctggttatctagtaaaccagagttctgcatcaaggtcctaaacccctacatgcccacggtcatagaagaacttgaaaagctgcagcgtaagcacggtgggaacctggtccggtgccccctaagcagaaattcgactcatgaaatgtactgggtcagcggtgcaagcggaaacatagtcagtagtgtgaacacgacgagcaaaatgttacttaaccgttttaccacccgacaccgaaagcctacctatgaaaaggacgtggacctaggcgcgggcacccgctctgtaagcacagaaacagaaaaacccgacatgactattatcggcagaaggctacaacgactacaagaggaacataaagaaacatggcactacgaccaagaaaatccatatagaacctgggcctaccacggaagttatgaggcgccgtcgaccggaagcgcgtccagcatggttaatggtgtggtcaagctgcttacaaaaccctgggacgtaataccaatggttacgcaactggcgatgactgacaccacgccctttggtcagcagagagttttcaaggaaaaagtcgatacgcgaacccctcaaccaaaacccggaaccagaatggtgatgacgaccacggcaaactggctatgggcgctattgggcaagaagaaaaaccctaggctttgcactcgggaagagttcatatcaaaagtcagatcaaatgccgcaatcggggcggtattccaagaagaacagggttggaccagcgcaagtgaggccgtgagcgactcaagattctgggagttagtcgacaaagagagggcgctacaccaagaggggaaatgcgaatcgtgcgtctacaacatgatgggcaagcgcgagaagaaactaggcgagttcggccgggccaagggtagtcgagccatctggtacatgtggctaggagcccgatttctagagtttgaagcgctaggattcctgaacgaggatcactggttcggccgagaaaacagctggagtggggtcgagggggaagggctccacagattaggatacattctcgaagaaatagacaaaaaggatggagatctaatgtatgctgacgacaccgccggatgggacaccagaattacggaggacgaccttcagaacgaagagttaattaccgaacaaatggccccgcaccacaaaatattagcaaaggcaatatttaaactcacataccagaataaggtggtcaaagtcctccgacccacaccaaggggcgctgtcatggacataatcagtcgtaaagaccaacgcgggagtggacaagtaggaacgtacgggctaaacacgttcacaaacatggaagtccaactcatacgccagatggaggcagaaggggtaataactcaagacgacatgcagaacccgaaaggcctcaaagaacgtgtcgagaagtggttgagggaatgcggagtcgaccgcttgaaaagaatggcaatctccggtgatgactgcgtggtcaagcccttggacgaaaggttcggaacttccctgcttttcctcaacgacatgggaaaggtacgaaaggacatcccacagtgggaacccagcaagggctggaaaaactggcaagaggtaccattctgctcccaccactttcacaagatattcatgaaagacggtcgctccttggtcgtcccgtgccgaaaccaagacgaactgataggtagagccagaataagccagggagcaggctggtctctccgtgagaccgcatgccttggcaaggcatacgcgcaaatgtggagcctaatgtacttccatcgcagggacctacgactggcctccatggccatctgctcggcggtaccgacagaatggtttccgactagccgaaccacgtggtcaattcatgcgcaccatcagtggatgacgacggaggacatgctcaaggtctggaaccgcgtttggatagaggacaatccaaacatgatcgacaaaacgccagtgcacagttgggaagacataccctatttagggaaaagagaagacttatggtgtggttccctcataggactctcttcaagagctacatgggcgaaaaacatccacacagccatcacccaggttcggaacctcataggcaaggaagaatacgtagactacatgccagtaatgaagcggtactctgccccctccgaaagcgagggcgttctgtag

SEQ ID NO: 26232 - RNA, 9867 nt, synthetic construct
  misc_feature 1..9867: note = derived and/or modified CDS sequence (opt11) from DENV-4__GQ868584__SS-prME
  source 1..9867: mol_type = other RNA
agcaccatcaccctgttatgcctgatccccacagttatggccttccacctgtccacccgcgacggcgagcccctcatgattgtcgccaagcacgagcgagggcggcctctgctgttcaagaccaccgaaggcatcaacaagtgcacgctcatcgcgatggacctgggtgagatgtgcgaggacaccgtgacctacaagtgcccactgctcgtcaacaccgagcccgaagatatcgactgctggtgtaatctaacgagcacatgggtcatgtacgggacatgtacccaatccggggagcggagacgggagaagcgcagcgtggccctgacgccgcacagcggcatgggcctcgaaactcgggccgagacctggatgagctccgaaggggcatggaagcacgcccagagggtggaaagttggatcctccgcaaccccggcttcgcgttactcgccgggttcatggcctacatgatcggccagaccgggattcagcgtacggtatttttcgtgcttatgatgcttgtggcaccctcctacggcatgcggtgcgtcggagtgggaaacagggactttgtggagggcgtcagcgggggcgcgtgggtggacttggtgctggagcacggcgggtgcgtcacaaccatggcacaaggcaagccaaccctggacttcgagctcacgaagaccaccgccaaggaggtggccttactgcgtacctactgcatcgaagctctcatctccaatatcacgaccgcgaccaggtgcccgacgcagggggagccctacctgaaggaggagcaggaccggcagtacatctgccgccgggacgtggtcgatcggggctgggggaacggctgcggcctgtttggaaagggcggggtggtgacttgcgccaagtttagctgctccggcaagattaccgggaacctcgtccaaatcgagaatctggagtacaccgtggtggttaccgtgcacaacggcgacacgcacgctgtcggcaacgacaccagcaaccacggggtgaccgcaaccatcacgccccggtcccccagcgttgaggtaaagctgccggattacggcgagctcaccctggattgcgagccccgctccgggatcgacttcaacgaaatgattctgatgaagatgaagaagaaaacctggcttgtccataagcaatggttcctggacctgcctctgccctggacgaccggggccgacacctccgaggtgcactggaactacaaggagcggatggtcaccttcaaagtaccgcacgcgaagcgccaggacgttacggtccttgggtcccaggagggcgccatgcacagtgcgctggccggggccaccgaagtggacagcggtgacggcaatcacatgttcgcggggcacctcaagtgcaaggtgcgcatggaaaagctgcggatcaaaggcatgtcttacacgatgtgtagcggcaagttttccattgacaaagagatggccgagacgcagcacggtaccaccgtagtgaaggtgaaatacgagggcgccggggccccctgcaaggtccccatcgagatacgcgacgtgaacaaggagaaggtggtcggccgggtgatcagcgcgacgcccctcgccgaaaacaccaactcagtgaccaacatcgagctcgagcctccctttggagactcttatatcatgatcggcgtcggcaacagcgcactcactttacactggttccgcaaggggtcgtcaataggcaaaatgttcgagagcacttaccgcggggccaagcgcatggctattctcggcgagaccgcgtgggacttcgggtcggtcggcggcctgtttaccagcctggggaaggctgtgcaccaggtcttcggcagtgtgtacaccacgatgttcgggggcgtttcctggatgatacggatacttatcggtttcctggtcctatggatcgggactaattcccgcaacacgagcatggccatgacgtgcatcgcagtgggcgggatcacgctgtttctcggcttcaccgttcaggccgacatggggtgtgtcgtgtcctggtccggccgcgaactgaagtgcgggtccgggatcttcgtggtcgacaacgtgcacacctggacagaacagtacaaattccagcccgagagcccggcgcgcttggccagcgccatcctcaacgcccacaaggacggcgtgtgtggaattcggtcaacgacccgcctggagaatgtgatgtggaagcagatcacaaacgagctgaactacgtgctctgggagggcgggcacgaccttaccgtggtcgctggggacgtgaagggcgtgttgacgaaagggaaacgggcgttagccccgcccgccagcgacctaaagtacagctggaaaacgtggggcaaggccaagatattcacccccgaggcccgcaacagcaccttcctcattgacgggcccgacacgtccgaatgccccaacgagcggcgcgcgtggaacagcttcgaggtcgaggattacggattcgggatgttcaccaccaacatctggatgaagtttcgggagggctcctcagaggtgtgcgaccaccgcctcatgagtgccgccatcaaggaccagaaggcagtacacgcggacatgggctactggattgagagctccaagaaccagacttggcagatagagcgggccagcttgatcgaagtcaagacatgcctgtggcccaaaacccacaccctctggtccaatggggtgctagagagccagatgctgatccccaagtcctatgccggcccgttcagccagcacaactaccgccaggggtacgccacccagaccgtggggccctggcacctcgggaagctggagatcgacttcggagagtgccctggcacgaccgtcaccattcaggaggattgcgaccacagggggccatccctacgaaccacgaccgcctcaggcaagctcgttactcagtggtgctgccgctcttgtaccatgccgcccctgcggttcctgggggaggacggctgctggtacgggatggagatccgccccctctccgagaaggaagagaacatggtgaagagccaggttaccgcgggccagggaacctccgagaccttcagcatgggactgctgtgcctaacgttattcgtggaggaatgcctgcggcgcagagtcacgcgcaagcacatgattctcgccgtggtgatcaccctatgcgccattatcttgggagggctcacatggatggacctgctgcgggccttaatcatgctgggagacacaatgtccggccgcatcggaggccagacgcacttagccataatggcggtcttcaagatgagcccggggtacgtgctcggcgtgttcctgcggaagctgacctcccgcgagaccgccctcatggtcatcggtatggccatgacgacgaccctgagcatcccgcacgacctgatggagctcatcgacggcatctccctgggcctgatcctcttaaagattgttacccagtttgacaacacccaggtcggcaccctggcattaagtctgaccttcatccggtcgaccatgagcctggtcatggcgtggcgaaccatcatggcggtgctcttcgtggtgactctgatccctctgtgccgcacatcctgcctccagaagcaaagccactgggtggagatcaccgccctgatcctgggggcccaggcactccccgtttacctgatgaccctgatgaaaggggcgagccgccggagctggccccttaacgagggcatcatggccgtcgggctcgtgagcctgttgggtagcgccctgctgaagaacgatgtgcccctcgcaggcccaatggtcgccggtggcctgctgctcgcggcctacgtcatgtccgggagcagtgccgacctgtccctggagaaggccgccaacgtacaatgggacgaaatggcggatatcacgggcagcagccccatcatcgaggtcaagcaggacgaggacgggagcttctccattcgcgatgtcgaggagaccaatatgatcaccctcctagtgaagctggcattgatcacggtcagcggcctgtacccactagccattccggtgaccatgaccctctggtacatgtggcaagtaaagacccagagatccggtgccctgtgggacgtgcccagccccgcagcgacccagaaggccgctttatcagagggggtctaccgcatcatgcagcgggggctcttcgggaagacccaggtgggggtcgggatccacatggagggcgtgttccacacgatgtggcatgtgacacgcggcagcgtgatttgtcacgagaccgggcgcctagagccctcctgggccgacgtgcgtaatgacatgatcagctacggcggggggtggcgcctcggagacaagtgggacaaggaggaagacgtgcaggtcctcgccatcgagcccgggaaaaaccccaagcacgtgcagaccaagcccggcctgttcaagacgctaaccggcgagatcggcgcggtgacactcgacttcaaacccgggacgtccggaagcccgatcatcaaccggaagggcaaggtcattgggctgtatggcaacggggtggtgacgaaatccggcgactacgtgagcgccatcacccaggcagagaggatcggggagccggactacgaggttgacgaggatatcttccggaaaaagcgcctgaccatcatggacttacacccaggcgccggcaagaccaagcggatcctgccgtccatcgtgcgcgaggcgctgaagcgccgactgcggacgctgatcctcgccccaacccgcgtcgtggctgctgagatggaggaggccttgcgagggctccccatcaggtaccagacccccgcggttaaaagcgagcacaccggccgggaaatcgtcgacctgatgtgccacgccactttcactacacgccttctctccagcacccgtgtgccgaactacaacctcatcgtgatggatgaggcacacttcacggacccctcatccgtcgctgcccgcggctacatctccacccgggtggagatgggtgaggcggccgccatcttcatgaccgccaccccccccggcgccacggacccgttcccccagtccaacagccccattgaggacatcgagcgtgagatccccgagcgctcctggaacacaggcttcgactggatcacagactaccagggaaagaccgtctggttcgtgccgtctatcaaggcggggaacgacatcgccaactgcctgcggaagtccggcaagaaggttatccagctctcgcgcaagacgttcgacaccgaataccccaagactaaactgaccgactgggacttcgtcgtgacgaccgacatctccgagatgggggcgaacttccgggcgggccgtgtgatcgaccccagacgctgcctgaaacccgtgatccttaccgatgggccggaacgggtgatcctggcgggccccatccctgtgactcccgccagcgccgcccagcgccggggcaggatcgggaggaacccggcccaggaagacgatcagtacgtgttctccggagatccactgaagaatgatgaggaccatgcgcactggacggaggccaagatgttgcttgacaacatctacacccccgaggggattatacccaccctgttcggcccggaacgcgagaagacccaggccatcgacggcgagttccggctccgcggggagcagcgcaagacgttcgtggagctgatgcggcggggcgacctccccgtatggctcagctacaaggtcgcctccgctgggattagctacaaggacagagagtggtgcttcacaggcgagaggaacaatcagatcctggaggagaacatggaggtggagatctggaccagggagggagagaagaagaagctacggcccaaatggctcgacgcgagggtgtacgcagacccaatggccctgaaggacttcaaggagttcgcctcggggcgcaagagcataacgttggacatcctcaccgagatcgcctccctgccgacttacctgagctcccgcgcgaagctcgccctggacaacatcgtgatgctgcacacaaccgagcgcggcgggcgagcctaccagcacgccctcaacgagctgcccgagagcctggagaccctcatgctggtggcgctgctaggcgctatgacggcagggattttcttattcttcatgcagggcaaggggatcggcaagctgagcatgggcctcatcaccatcgccgtggcctccgggttgctgtgggtcgcagagattcagccccagtggatcgcagccagcatcatcctcgagttcttcctgatggtgctgcttatcccggagccagagaagcaacgaaccccgcaggacaaccagctgatctacgtgatcctgacgatcctcacgatcatcgggttaattgcagccaacgagatggggctgatcgagaagaccaagaccgacttcggtttctaccaggtcaagaccgaaacgaccatcttagacgtggacctaaggcccgcttccgcctggaccctgtacgccgtggccaccacgatactcaccccgatgctgcgccatactatagaaaacacctcggccaacctgtccctcgcggccatcgcgaaccaggccgccgtcctaatggggctcggcaagggctggcctctccaccggatggacctgggggtgccactgctggctatgggctgctacagccaggtgaatcctacgaccctgaccgcctccctggtcatgctcctggtccactacgctatcatcgggcctggcttacaggccaaagcgaccagggaggcgcaaaaacgtaccgccgctggcatcatgaagaaccccaccgtggacgggattaccgtgatcgacttagagcccatcagctacgaccccaaatttgagaagcagctgggccaggtgatgctgctcgtgctgtgcgccgggcagctgctcctgatgcgcaccacatgggcgttctgcgaggtcctcaccctcgccaccggacccatcctgactctgtgggaggggaacccaggccggttctggaacacgaccatcgccgtgtccacggccaacatattccgcggcagctacctcgccggggcggggctggccttctccctgatcaagaacgcccaaacgcctaggcgcggcacaggcaccaccggggagacgctcggcgagaagtggaagcggcagttgaacagcctggaccggaaggagttcgaggagtacaagcgctcgggcatattggaggtggacagaacagaggccaagagtgccctgaaggacgggtccaagataaagcacgcggtctcccgaggctccagcaagatccgctggatagtggagcgcgggatggtgaagcccaaaggcaaggtcgttgacctggggtgcggccggggcgggtggagttactatatggccacgcttaagaacgtcaccgaggtcaaaggctacaccaaggggggccctgggcacgaggagccgatccccatggccacctacggctggaatttggtgaagttgcactcaggcgtggatgtcttctacaaacccacggaacaggtggacaccctcctgtgcgacatcggggaatcgtccagcaacccgacaatcgaagagggccgcacactgcgggtcctcaagatggtcgagccctggctgtccagcaagcctgagttctgcattaaggtgctaaacccatacatgccgacggtgatcgaggagctggagaagctccagcgcaagcatgggggtaacctggttcgttgtcccctgtcccgcaacagcacccacgagatgtactgggtgtccggtgcctcgggcaacatcgtttccagcgtgaacaccacctcgaagatgctcctcaaccggtttacaacccgccaccggaagcccacatatgagaaagacgtcgacctgggcgcggggacccgcagcgtctccacggagaccgagaagcccgacatgaccatcatcggccggcgcctgcagcgtctgcaggaggagcacaaagagacctggcactacgatcaggaaaacccgtaccgcacgtgggcctaccacgggagctacgaggcaccctccaccggctctgcttccagcatggtaaacggcgtggtaaagctcctcacgaagccttgggacgtgattccgatggtgactcagctggctatgacagacaccacgcccttcggccagcagcgggtcttcaaggagaaggtggacacacgcacgccccaacccaagccgggcaccaggatggtgatgaccacgacggcgaactggttatgggccttactagggaagaagaagaatccacgcttgtgcacacgggaagaattcatttctaaagtccgcagcaacgcggccatcggtgccgttttccaggaagagcaggggtggaccagcgcgtccgaagccgtcagcgacagtcggttctgggagctcgtcgacaaagagagagccctgcaccaggaaggcaagtgcgagagctgcgtgtacaatatgatggggaagcgcgagaagaagctaggggagttcggcagggccaaagggtcccgcgccatctggtacatgtggctcggcgcgcggttcctggagtttgaggccctggggttcctcaacgaggaccactggttcggccgcgagaacagctggtccggcgtggagggagagggcctccatcgactggggtacatcctcgaggagatcgacaagaaggatggagacctgatgtacgcagacgacaccgccggctgggacacgcggatcaccgaggacgacctgcaaaacgaggagctcatcactgagcagatggcgccccaccacaagatccttgccaaggccatcttcaagctgacctatcaaaacaaggtcgtgaaggtgctccggcccaccccgcgcggggccgtcatggatattattagccggaaggaccagcgcggctccgggcaggtgggcacctacgggctgaacaccttcaccaacatggaggtacagcttatccggcagatggaggccgagggcgttatcacccaggacgacatgcaaaaccccaagggcctcaaggaacgcgtggagaaatggttgcgggagtgcggggtggacagactgaagcggatggcgatcagcggcgacgactgcgtcgtgaaacccctcgacgagcgcttcgggacctccctgttgttcctcaacgacatggggaaggtgcggaaggacatcccccagtgggagccgagcaaggggtggaagaactggcaggaggtccccttctgctcccaccacttccacaagatctttatgaaggacggcaggtccctggttgtgccctgccggaatcaggacgagcttattggcagagcacgcatatcccaaggggcaggttggagcctccgggagaccgcttgccttgggaaggcctacgcgcagatgtggtccctgatgtacttccacagacgggacctccggctggccagcatggcgatctgctctgcggtccccaccgagtggtttccgacctcccgaacgacctggagcatacacgcccaccaccagtggatgaccaccgaggatatgctgaaggtgtggaatcgcgtgtggatagaggacaaccccaatatgatcgacaagacgcccgtacactcttgggaggacatcccctacctcgggaagcgggaggacctgtggtgcgggagtctgatcggcctctcctcacgcgcgacctgggccaaaaacatccacacggccattacccaggtgagaaacctgatcgggaaggaggagtacgtggactacatgccggtcatgaagcgctactctgccccaagcgagtccgagggggtcttgtga

SEQ ID NO: 26233 - RNA, 9867 nt, synthetic construct
  misc_feature 1..9867: note = derived and/or modified CDS sequence (opt11) from DENV-4__GQ868585__SS-prME
  source 1..9867: mol_type = other RNA
agcaccataacactgttatgcttaatacccactgtgatggcctttcacctgtccactcgcgacggtgagcccttgatgatcgtagccaagcacgagcgagggcgccccctgctgtttaagacaaccgaggggatcaacaagtgcacgcttatcgccatggatctgggggagatgtgcgaagacaccgtgacctacaagtgccccctactcgtgaacaccgagcccgaggacatcgactgttggtgcaacctgacgtctacctgggtgatgtacgggacctgtacccaatccggggagcgacgccgggagaaacgatctgtggccctaaccccacattccggaatgggcctcgagacccgggccgagacctggatgtcctcggagggtgcctggaagcatgcccagcgcgttgagagctggatcctccggaaccctggcttcgctttactcgcagggttcatggcctacatgatcggccagaccgggatccagaggacggtcttctttgtgctaatgatgcttgtggccccctcctacggcatgcggtgcgtcggcgtgggaaaccgcgacttcgtggagggtgtcagcgggggtgcctgggtggacctcgtgctggaacacggcgggtgcgtgaccactatggctcagggcaagcccaccctggacttcgaactcacgaagaccaccgccaaggaggtggccctgctaagaacctactgcatcgaggccctgatctcgaatatcaccaccgcgacccgttgcccgacacagggggagccctatctcaaggaagagcaggaccagcagtacatctgtaggcgcgacgtggtagaccggggctgggggaacggctgcggcctgttcgggaagggcggagtggtaacgtgcgctaagttcagctgctccggcaagatcaccggcaacctcgtgcagatcgagaacttagaatacaccgtagttgtcaccgttcacaacggcgacacccatgcagtgggcaacgataccagcaaccacggggtaaccgccactatcacgccccgctcccccagtgtggaggtcaagctgcctgactacggcgagctcacgttggactgcgagccccggtccgggatcgatttcaacgagatgatactgatgaagatgaagaagaagacctggctcgttcataaacagtggttcctggacctgccgctcccatggaccaccggtgccgacacgagcgaggtgcactggaactacaaggaacgtatggtgacctttaaggtaccgcacgcgaagcggcaggacgtgacggtcctggggtcccaggagggcgccatgcactctgccctggccggggccactgaggtagatagcggggacgagaatcacatgttcgcgggtcacctcaagtgcaaagttcgcatggagaaactgcgcatcaaggggatgagttatacgatgtgctcgggaaagttctcgattgacaaggaaatggccgagacccagcacggcacgaccgtcgtgaaggttaagtacgagggggccggggccccctgcaaggtacccatcgagatccgggacgtgaacaaggaaaaggtggtcgggcgggttatcagcgctacccctctggctgagaacaccaattccgtgaccaacatcgagcttgagcctcccttcggagactcttacatcgtcatcggggtaggcaactccgcccttactctgcactggttccggaagggctctagcatcgggaaaatgttcgagagcacgtacagaggcgctaaacggatggccattctcggcgagaccgcgtgggactttgggagtgtcggcgggctgttcacaagcttggggaaagccgtccaccaagtattcgggtccgtgtacaccacgatgttcggcggggtgagctggatgattcgcatcttgatcggctttctggtgctgtggatcggtaccaacagcagaaacaccagcatggcaatgacctgcatcgccgtcggcggcatcacgctgttccttgggttcacagtccaagccgacatgggctgcgtggtgtcgtggagcgggcgcgaactgaagtgcggctccgggatctttgtagtggacaacgtgcacacctggaccgagcagtacaagttccaaccggagagccccgcccggctggcctccgctatcctcaacgcccacaaagatggtgtctgcgggatccgctccacgacccggcttgaaaatgtaatgtggaagcagatcaccaatgagttaaactatgtgctctgggagggcggtcacgacctgacggtcgtggcaggggacgtgaagggtgttcttactaagggcaagcgcgcgctgacccctcctgccagcgacctgaagtactcatggaagacctgggggaaggcaaagatcttcacccccgaggcccggaactccacgttcctgatcgatggccccgacactagtgaatgcccgaacgagcgtcgcgcctggaacagcttcgaggtggaagactacgggttcggcatgttcaccaccaatatctggatgaagttccgcgaagggtccagcgaggtgtgcgaccaccggctcatgtcggccgcgatcaaggatcagaaggcagtccacgctgacatggggtactggatagagtcttccaagaaccagacctggcagatcgagcgcgcgagcctaatcgaagtgaagacctgtttgtggccgaagacccacaccctctggtccaacggcgtcttagagagccagatgctgattcccaagtcctacgctgggccattcagccaacacaactacagacagggctacgccacccagacggttggcccctggcacctcggtaaactggagatcgacttcggggagtgccccggaactacagtgaccatccaggagaactgcgaccaccgtggcccctccctgcgcacgactaccgccagcgggaagctcgtgacccagtggtgctgccggtcttgcacgatgccgcccctgcgcttcctgggcgaggacggctgttggtacggtatggagattcggcctctctccgagaaggaggaaaatatggtcaagagccaggtgactgccgggcagggcacctccgagaccttcagcatgggactgctgtgcctcacgctgttcgtcgaggagtgcctgcgccggcgcgtgacccggaagcacatgatcctagcggtcgtgattactctgtgcgccatcatcctcgggggcctcacctggatggacctccttcgcgccttgatcatgctcggggacaccatgtccggccggatcggaggacagacccacctggctatcatggccgtgttcaagatgagccctggttacgttctcggggtcttcctgcgcaagctgacctcccgggagactgcgctcatggtcatcggcatggcaatgacgaccaccctgagcatcccgcacgatctaatggagctcatagacgggatctccctggggcttatcctcctgaagatagtgacccaattcgacaacacgcaggtaggcactctggcgctctccctgacattcatccgctccaccatgagcctggtgatggcctggagaacgatcatggccgtcctcttcgtcgtgaccctgatccccctgtgccgcacctcgtgcctccagaagcaaagccattgggtggagatcaccgcgctgatactgggggcccaggccctccccgtatacctgatgacgctgatgaagggcgcctcccggcgctcatggccgctcaacgaggggatcatggcggtagggctcgtgtccctgcttgggagcgccctattaaagaacgacgtcccgctcgccggccccatggtggccggcgggttgctcctcgcagcttacgtgatgtccggcagcagcgccgacctgtccctggagaaggccgccaatgtccaatgggacgagatggctgacatcacagggagctcccccatcatcgaggtgaagcaggacgaagacggcagcttctccatccgggacgtggaggagaccaacatgatcacgctcctggtcaagttagcgctcatcacggttagcggtctctatcccttagccattccgataaccatgaccctctggtacatgtggcaggtcaagacccaacgctccggcgccctgtgggacgtacctagccctgccgcaacccagaaggcggccctgtccgagggtgtttatcggatcatgcagcgcggcctcttcggcaagactcaagttggggtcggcatccacatggagggggttttccataccatgtggcacgtgacccggggtagcgtcatttgccacgaaaccggtcgactggaaccctcctgggccgatgtacggaacgacatgatcagctatggggggggttggcggctgggcgacaaatgggataaggaggaggatgtgcaggtcctcgcaatcgagccgggcaagaacccaaagcacgtgcagacgaagcccgggctgttcaaaaccctaaccggggagataggtgccgtgaccctcgacttcaagcccggcacgtccggatccccgattatcaaccgcaagggcaaggtcataggcctatacggtaacggcgtggtgaccaagtcaggtgactacgtcagcgcgatcacccaggccgaacgcatcggcgagcccgattatgaggtggacgaggacatcttccgcaagaagcggctgactataatggacctccatcctggggccggcaaaacgaagcgcatccttccttccatcgttcgggaagcgttgaaacgccggctacgcactctcatcctggcgcccacccgggtggtcgccgccgaaatggaggaggccctgcgtggcctacccatccggtatcagacccccgccgtcaagtctgagcacactgggcgcgaaatcgtcgatctcatgtgccatgccaccttcaccacccgtcttctctccagtacacgtgttccgaactacaacctgatcgtgatggacgaggcccacttcaccgaccctagctccgtggccgcccggggttacataagcacccgcgtggagatgggtgaggccgcggcaatctttatgaccgctacgccacccggcgccacggatccgtttccccagtccaactcccccatcgaggacatcgagcgggaaatccccgagagatcctggaataccgggtttgactggattaccgactaccagggcaaaacggtctggttcgtgccgtccatcaaggctggcaacgacatcgcgaactgccttcgcaagtccggcaaaaaggtgatccaactctcgcgcaaaaccttcgataccgagtaccccaagaccaagctgacggactgggatttcgtagtgaccaccgacatatccgagatgggcgccaacttccgcgccgggcgggtgattgatccaagacgctgcctgaagcccgtcattctgaccgacggcccggagcgcgtgatcctggccgggcctatcccggtgacgcccgcgtccgccgcacagcggcggggccgcatcggccgcaacccggcccaggaggacgaccagtacgtcttttccggagatcccttaaagaacgacgaggaccacgcccattggaccgaggcaaaaatgctcctggacaacatatacacacccgagggcatcatccccaccctgttcggcccggagagggagaaaactcaggccatcgacggtgaattccgactcaggggggaacagcgcaagactttcgtggagctgatgcggcgcggcgacctgcccgtatggctctcgtacaaggtcgcgtccgccggcattagctataaggaccgggagtggtgcttcaccggggaacgcaacaaccaaattctggaagaaaacatggaggtcgagatctggactcgggagggcgagaagaaaaagctgcgccccaagtggttggacgcccgggtgtacgcggaccccatggccctgaaggacttcaaggagttcgcctccgggcgcaagagcatcaccctggatatcctcacggaaatcgcctccctcccgacctacctgagctcccgcgccaaactcgcgctggacaacatcgtcatgctgcataccaccgagcgtggggggcgcgcctaccagcacgcgctaaacgaattacccgagtctctggagacactcatgttagtggcactgctcggggcaatgaccgcaggcatcttcctgttcttcatgcaggggaagggcatcgggaagctgagcatgggcctcataaccatcgcagtggcctccggccttctgtgggtcgccgagatccaaccccagtggatcgcagcctctattatactcgagtttttcctcatggtgctgctaataccggagcccgagaaacagcggactccccaggacaaccagcttatttacgtcatcctgacgattctcaccatcattgggctcattgccgcaaacgaaatgggcttgatcgaaaagacaaagaccgactttgggttctaccaagtcaaaacggaaaccaccattttggacgtggacctgcgccccgcctccgcttggacattatacgccgtggcgacgaccatcttaacccctatgctgcggcataccatcgagaacacgagcgctaacctctcactggccgcgatcgctaaccaggccgcagtcttgatgggcctggggaagggctggcctcttcaccgcatggacctgggggtgcccctgctcgccatggggtgctacagccaggtaaaccccaccaccctgaccgcgtccctggtcatgctcttagtgcactacgccatcatcggcccgggcctgcaggccaaggccacgcgggaggcccagaagaggacagccgccggcatcatgaagaaccccaccgtggacggcataaccgttatcgatctcgagcccatcagctacgaccccaagttcgagaagcagctgggccaggtgatgctgttggtgctgtgcgccggccaacttctcctcatgcggacgacatgggccttttgcgaggtcctgaccctcgcgaccgggccgatactgacgctgtgggaggggaaccccgggcgcttttggaacactaccatcgccgtgtccaccgccaacattttccggggctcctacctcgctggcgccgggctggccttctccctgatcaagaatgcccagacgccccgccggggcactgggaccaccggcgagacccttggtgagaaatggaagcgccagcttaactcgctggaccgcaaggaattcgaagagtacaagcgctccggcatcctcgaagtggaccggacggaagcgaaaagtgctctgaaggacggatccaagatcaagcacgccgtcagccgcggatcctcgaagatcaggtggatcgtggaacgcggcatggtgaagccgaaggggaaggtcatcgatctgggttgcggtcgcggcggttggtcctactacatggctacccttaagaacgtgaccgaggttaagggatacaccaagggcgggccgggccacgaggagcccatccccatggccacgtacgggtggaacctggtcaagctgcatagcggcgtggacgttttctacaaaccaactgagcaagtcgacacactattgtgcgacattggcgagagctccagtaacccaaccattgaggaggggcggacgctgcgcgtactcaagatggtggagccctggctgtccagcaagcccgagttctgcattaaggtcctgaacccttatatgccgaccgtgattgaggagcttgaaaagctacagaggaagcatggcgggaatcttgtgcgctgccccctgagtcgaaattcaacccatgagatgtactgggtctctggcgccagcggcaacatcgtgtctagcgtcaacactacgagcaagatgcttcttaaccgcttcaccaccaggcatcgcaagcccacatacgagaaggacgtagacctgggcgcaggaacgcggagcgtgagtaccgagactgaaaagcccgatatgaccatcatagggcgccggctccagcgcctgcaagaggagcacaaggaaacgtggcactacgaccaggagaatccgtatagaacctgggcgtatcatggcagctacgaagccccgtccaccgggagtgcctcctcaatggtcaacggcgtggtgaagctgctcactaaaccctgggacgtcatcccgatggtgacgcagctcgccatgacggacaccacccccttcggccagcagagggttttcaaagagaaggtggacacgcggacaccccagcctaaacctgggacccgcatggtgatgaccaccaccgccaattggctgtgggccctcctgggtaaaaagaagaatccgcggctgtgtacccgagaggaattcatctcaaaggtgcggagcaacgcagcaataggggccgtcttccaggaggagcagggctggacctcagccagcgaagcggtaaacgatagcagattctgggagctcgtggacaaggagcgagcgttacaccaagaggggaagtgcgaatcctgcgtctacaatatgatgggaaagcgcgaaaagaaactgggcgagttcggccgtgctaagggcagccgtgccatttggtacatgtggctcggggctagattcctggagtttgaggcgctggggttcctcaacgaggaccactggttcgggagagagaactcctggagcggcgtggaaggcgaggggctgcaccgcctgggttacattctcgaggagatcgacaaaaaggacggggatctgatgtacgccgacgacacggccggctgggacacccggataacagaggacgacttgcagaacgaagagctcatcaccgagcagatggctccccaccacaagatcctggctaaagcaatattcaagctcacctaccagaataaggtggtaaaggttctccgccccacgccgcgtggtgcggtgatggacatcatatcccgcaaggatcaacgcgggagcggccaggtcggcacttacggactgaacaccttcacaaacatggaggtgcagctgatcaggcagatggaggccgagggggtgatcacccaggacgatatgcaaaatcccaagggtctgaaggagcgggtcgagaagtggctgagagagtgtggcgtggaccggctgaagcggatggctatctccggggacgactgcgttgtcaagcccctcgacgagcggttcggcacctcactgctgttcctcaacgatatgggtaaggtgcgcaaagatattccacagtgggaaccttccaagggatggaagaactggcaggaggttcccttctgtagccaccacttccacaagattttcatgaaagacgggcggtcccttgtcgtgccctgcagaaatcaggacgagctgatcggccgggcgaggatcagccagggcgcggggtggagtctccgcgagaccgcctgcctgggcaaagcctatgcccagatgtggtctttaatgtatttccaccggcgcgacctccggctggcgtccatggccatctgtagcgccgtacctacagagtggttcccgacgagtcgcaccacctggtccatccacgctcatcatcagtggatgaccacggaggacatgctaaaggtttggaacagagtttggatcgaggacaaccccaacatgatcgacaagacccctgtgcacagctgggaggacatcccctacctcggcaagcgcgaggacctgtggtgcggctcactgatcggcctcagcagccgggctacctgggcgaagaacatccacaccgccataactcaagtccgaaacttgatcggcaaggaggagtacgtcgactacatgcccgtgatgaagcgctatagcgcccccagtgagagcgagggcgtcctgtga

SEQ ID NO: 26234 - RNA, 9867 nt, synthetic construct
  misc_feature 1..9867: note = derived and/or modified CDS sequence (opt11) from DENV-4__JQ922560__SS-prME
  source 1..9867: mol_type = other RNA
agcaccatcacgctgctctgtctgatccccaccgtaatggcctttcacctgtccacgcgggacggcgaaccgttgatgattgtggccaagcacgagcgggggagacggctactgttcaaaaccaccgaggggatcaataagtgcaccctgattgccatggacctgggagagatgtgcgaggataccgtgacctacaagtgcccccttctagtgaacacggagcccgaggatattgactgctggtgcaacctgaccagcgcctgggtgatgtacgggacctgcacccagtccggggaacgacggcgcgagaagcgcagcgttgccctgacgccccactccgggatgggattagagacccgagcagagacctggatgagctctgagggggcctggaagcacgcccagcgagtggaatcatggatcctacggaaccccggcttcgccctgctggcgggcttcatggcctacatgatcggccagactgggattcaaaggaccgtgttctttatcctaatgatgctggtagcgccctcctacgggatgcgatgcgtgggcgtggggaaccgtgacttcgtggagggcgtttctgggggggcctgggtcgacctcgtcctggagcacggtgggtgcgtcaccacaatggctcaaggcaagccaaccctggacttcgagctcataaagacgacagccaaggaggtcgcactgctgcgcacctactgcatcgaggcgtccattagcaatatcactactgctacgcggtgtccaacccagggtgaaccttatctcaaggaggagcaagatcagcagtacatctgccgccgggatgtggttgatcgcggctgggggaacggatgcggcctattcgggaaggggggtgtcgtaacctgcgccaaattctcctgcaccggtaagataacggggaacctgatccagatagagaacctcgagtacaccgtggttgtaaccgtgcacaacggggacactcacgccgtcggcaatgacacgtccaaccatggggtgaccgcaaccatcacgccgcggtccccctcagttgaggtggagctgccagactacggggagctgacactcgactgcgagccccgttctgggatcgactttaacgagatgatcctaatgaaaatgaacaaaaaaacgtggctggtgcacaagcagtggttcctcgacctgcccctgccctgggcggctggtgccgacacgagcgaggtacactggaaccacaaggagaggatggtcacgttcaaggttccccatgccaagaggcaggacgtaaccgtcctcgggtcccaggaaggagccatgcacagcgcgctgaccggcgcgaccgaggtctactcaggggacggcaatctgatgttcgccgggcacctcaaatgtaaagtgcgcatggaaaagttgcggatcaaaggcatgtcctatactatgtgctcaggcaagttttccatcgacaaagagatggccgaaacccagcacgggaccacagttgtgaaggtcaaatacgaaggcgccggagctccctgcaaagttcccatcgaaatccgcgatgttaacaaagagaaggtcgtaggccgagtgatctcatcaaccccattcgccgaaaacaccaacagcgtaacgaatatagaattggagccgccttttggagactcctacattgttatcggcgtgggagacagtgcgctaaccctgcactggtttaccaagggctcctctattggaaagatgttcgaatccacttaccgaggggcaaagcggatggccatcttaggcgagacggcgtgggacttcgggagcgtcggcggcctactgacctccctggggaaggccgtgcaccaagtgtttgggagcgtgtacacaactatgttcgggggcgtgtcttggatggtgagaatcctcattgggttcctggtcctgtggatcggcaccaactctcggaacacctcaatggcgatgagctgcatcgctgtcggcgggattaccctgttcctgggcttcactgtgcacgcggacatggggtgcgccgtcagttggtcgggcaaagagcttaaatgcgggtcgggcattttcatcatcgataacgtgcatacttggacggagcagtacaagttccagcccgagtctccagcacgcctagccagcgccatcctgaacgcgcacaaagacggcgtatgcggcatccggagtaccacccgcctggagaacgtcatgtggaaacagatcacgaacgagctgaattacgtgctctgggaggggggccacgacctgacagttgtcgccggggacgtgaagggcgtgctcagcaagggtaagcgcgccttagcgccgcccgtgaacgacctgaagtactcgtggaagacctggggaaaggccaagatctttactcccgagacgcgaaacagcacgtttctaatcgacggtcccgatacctccgagtgccctaacgagaggagagcctggaacttcctcgaggtagaggactacggcttcgggatgtttactacgaacatatggatgaagttccgggaaggcagctcggaaatgtgtgaccatcgcctgatgagcgccgcaatcaaggaccagaaagccgtgcacgcggacatgggctactggatcgagtcgagcaagaaccagacgtggcagatcgaaaaggcctcactgatcgaggtgaagacctgcctctggccaaagacgcacacgctgtggtccaacggcgtgctcgagtcccagatgctcatacccaaggcctatgccggcccattcagccagcataactaccggcaaggttacgcgacccaaaccgtggggccatggcacctgggcaagctggagatcgacttcggcgagtgcccgggcaccacggttacgatccaggaagactgcgatcatcgtggtccatccttgcggaccacaactgcgagtggcaagctggtcacccaatggtgctgccggtcgtgtacaatgccccctctgcgcttcctcggcgaggacggctgctggtatgggatggagatacggcccctatccgagaaggaagagaatatggtcaagtcgcaggtatccgccggccaaggaactagcgagacgttttccatggggttattatgtctaacgttgtttgtagaggagtgtctccgccgtagggtgaccagaaagcacatgatccttgtcgtggtcactacactatgcgccatcatcctgggcgggctgacgtggatggaccttctacgtgcgctgatcatgctgggcaacactatgtcttcccgaatggggggccagatacacttggctatcatggcagtgttcaagatgtcaccaggctatgtcctgggaatatttctgagaaagctcacctcacgggaaacggccctgatggtcatagggatggccatgacgacggtgctgagcatccctcacgacctgatggagtttgtcgacgggatatcactaggtctcatcctcctgaaaatggttacgcacttcgataacacccaggttggaacactcgccctctcgcttaccttcattaagtcgaccatgccgttagtgatggcctggcgtactatcatggcggtcctcttcgtagtaacgctgatccccctgtgccggacgagctgcttacaaaagcagtcacactgggtcgagattaccgccctcatactgggagctcaagccctccccgtctacctgatgacactaatgaagggagcgtcaaagcgctcctggcccctcaacgagggaatcatggccgtgggcttggtctctctgctcggttccgccttgctaaaaaacgacgtgccgttggccggccctatggtggcaggcggccttctgctcgctgcatacgtcatgagcgggtctagtgccgacctaagcctcgagaaggcagccacggttcagtgggatgagatggcggacatcaccggatccagccccatcatcgaggtgaagcaggacgaggacggttccttctctattcgggatgtcgaggagacaaacatgataaccctcctggtcaagcttgccttaatcacggtgtccgggctctaccccctggctatcccggtcaccatgacactatggtacatgtggcaggtcaaaacccaacgcagtggcgccctgtgggacgttccctccccggcagcggcccagaaggccacgcttaccgaaggagtataccggatcatgcaacgtggcctcttcggtaagacccaggtcggtgtgggtatccatatggagggcgtctttcacactatgtggcatgtgacgcgaggctcggtaatatgccacgagtccggccgcttagagccgagctgggccgacgtccgcaacgacatgatctcctacgggggcggatggcgccttggcgataagtgggataaggaggaagacgtacaggtgctcgccgtagagccgggcaagaaccccaaacatgtgcaaacaaagccaggcctgtttaagactctaaccggcgaaatcggggcggtgaccctcgacttcaagcccgggacgagcggttccccgattataaaccggaaagggaaagtcatcggcctgtatggaaatggcgtggtgacgaagtcgggggactatgtttccgcgataacccaggccgagcgcatcggcgagcccgactacgaagtggacgaggatattttccgcaagaaacggttaacaataatggacctccaccccggggccggcaagaccaagaggattctgccaagcatagtgcgggaggcgctgaagaggcggcttcgcaccctcatccttgcccccacccgggtagtcgctgccgagatggaagaagccctgaggggcttacccatccgttaccaaacccccgcggtgaaatcggaacacacggggcgcgaaatcgtcgaccttatgtgccacgccaccttcaccacccggctgctcagctcaacgcgtgtgccgaactataaccttatagttatggacgaggcccattttaccgacccctcctctgtagcggcgcggggctatatcagcacgcgcgtggaaatgggagaggcggccgccattttcatgaccgccacgccgcccggcaccaccgacccgttcccgcagagcaactcccccatcgaggacatcgagcgggaaatccccgagcgcagctggaataccgggttcgactggatcactgactaccaaggcaagactgtctggttcgttccttccatcaaagcaggcaacgacatcgcgaattgcctgcgaaagtctgggaaaaaggtagtccagttgtcgcggaagaccttcgacaccgagtacccgaagacgaagctgacagattgggacttcgtcgtgaccacagacatatctgaaatgggcgccaacttccgtgccgggcgagtaatcgacccccgccggtgcctgaagcccgtgatcatcacagatggccctgagcgggtaatactcgccggacccatccccgtcacccccgcgtccgcggcccagagacgcggtcgaatcggccgcaacccagcccaggaggacgaccagtacgtattctcgggcgaccctctgcggaacgacgaggaccacgcacactggaccgaggcaaaaatgctactcgacaacatctatacacccgagggcatcatccccacgctgttcgggccagagcgcgaaaagactcaagcaattgacggcgagttcaggctgcgcggcgagcagcgaaagaccttcgtggagctcatgaggcgcggtgacctgcctgtctggttatcctacaaggtcgccagtgctggcatctcctacaaggaccgcgagtggtgcttcaccggggagcggaataaccaaatactcgaggagaacatggaggtcgagatatggacaagagagggtgagaagaagaagctccgacccaagtggctggacgcccgcgtgtatgcggatccagtggcactcaaggacttcaaggaattcgccagcgggcggaagtccataaccttagatatattgaccgagatcgccagcctccctacctatctgtcaagccgtgccaagctggcgttagataacatcgtgatgctgcacacaacggagcggggcggaaaagcctaccagcacgccctgaacgagctacccgagagcctcgagaccctaatgctcatcgccctactgggggcgatgaccgcgggcatcttcttatttttcatgcaaggcaaaggtatgggaaagttatcgatgggcctcatcgccatcgccgtcgccagcggcctcctgtgggtggcggagatccagccgcaatggattgccgcctcaatcatcttagaattcttcctgatggcgttgctgatcccagagcccgagaaacagagaacgccccaggacaaccaactcatctacgtcatattgactatcttaaccattattgggctcgtagccgcgaatgagatgggcctgatcgaaaagacaaaaaccgactttggtttttatcaggagaagacggagaccactattctggacgtagacctcagacccgctagcgcctggaccctgtatgcggtggccacgaccatcctgaccccgatgctccggcacaccattgagaacacgagtgcgaatctgagcctcgccgccatcgctaatcaggccgcggtgttaatgggcctggggaagggctggcccttacaccgcatggacctcggcgtgccgctgctggcaatggggtgctatagtcaggtgaaccccaccacactaaccgccagcctggtcatgttgctcgtgcactacgccatcatcgggcccgggcttcaggctaaagctacccgggaggcccagaagcggactgcagccggcatcatgaagaatcccacggtagacggcatcaccgtcatcgatctggagcccatttcctatgacccgaagtttgagaagcagctcggacaggtgatgcttctggtgctctgtgctggtcagctgctgctcatgcgtacgacttgggccttctgcgaggtcttgacactagccaccgggccgattcttacgctttgggagggcaaccctggtcgtttctggaacacaaccatagcagtgagcaccgccaatatattccggggctcttacctggcgggtgccgggctagcattcagccttatcaagaatactcagacccctcggcgggggaccgggaccacgggagagaccctgggagagaagtggaagcgccagctcaactccttagatcggaaagagttcgaagagtacaagcgctcgggcatactggaggtggatcggaccgaggctaaatccgccctcaaggacggcagcaagatcaagtacgcggtttctcgcggcaccagcaagatcagatggatcgtggagcgcggcatggtgaagccaaaggggaaggtggtggacctaggctgtgggcggggcggctggtcctactacatggcaaccctcaagaacgttacggaggtcaaggggtacaccaagggtggcccaggccacgaagagcccatcccgatggcgacatacggttggaatctcgtgaaactgcatagcggggtggacgtattctataaaccaaccgagcaggtggacactctgctgtgcgacataggagaaagctcctccaatccgaccatagaggaagggcgaacccttcgggtcctgaagatggtcgagccttggctctccagcaaacccgaattctgcatcaaggtgctgaatccttacatgcccaccgtaatcgaggaactggagaagctccaacgcaagcatggtggctcccttgtccgctgccccctaagccggaattccacacacgagatgtactgggtgagcggcgtctcccgcaatatcgtctcttctgtgaacacaacgagcaaaatgttactcaaccgtttcaccacgcgctaccggaaacccacgtacgaaaaagatgccgacttgggtgcggggacgcgcagcgtaagcactgaaaccgaaaaacccgacatggccatcatcggccggcgcttgcaacggctccaggaggagcacaaggaaacatggcactacgaccaggagaatccataccgtacctgggcctaccacggcagctacgaggccccgagcacaggctcagctagctccatggtcaacggcgtggtcaagctcctgacaaaaccctgggacgtggtgccaatggtcacccagctagctatgacagacaccactcccttcggccagcagcgggtatttaaggagaaagtagacacccggacgcctcagcctaagccggggacccggatgataatgaccaccactgccaactggttgtgggccctgctcggcaaaaaaaagaacccccggctctgtacccgggaggaattcatctcaaaagttcggagcaacgctgctatcggggcggtgtcccaagaagagcaagggtggacgagcgcctccgaggccgtgaatgatagcaggttctgggagcttgtcgacaaggagcgcgcgctccatcaagagggcaagtgcgagtcctgtgtctataacatgatggggaagcgggagaagaagctgggggagttcggccgggctaaggggagccgggcaatctggtatatgtggttgggcgcacgcttccttgagttcgaagccctgggattcctgaatgaggaccactggttcgggcgtgagaattcctggagcggagtcgagggcgagggcctccacaggctgggatacatcctggaggacatcgacaagaaagatggtgaccttatatatgccgacgacactgcgggatgggatactaggatcactgaggacgacctgctaaacgaggagctaatcacggagcagatggcgccccatcacaagattctggccaaggcaatcttcaaactgacctaccagaacaaagttgtgaaggtcctccgtcccactccgaagggggccgtcatggacatcatctccagaaaggaccaacgggggtccggccaggtcggcacctatggactcaacaccttcacgaatatggaagtgcaacttatccgacaaatggaggcggagggggtcatcacgcgggacgacatgcacaaccccaagggtctcaaggagcgcgtggagaagtggctaaaagagtgcggtgtggatcggttgaagcggatggctatctcaggcgacgactgcgttgtgaagcccctcgatgaacggttttcaacctcgctgctgttcctcaacgacatggggaaagtgcgcaaggacattccccaatgggagccgagtaagggctggaaaaactggcaggaggttcccttctgcagccatcatttccacaagatttttatgaaggacggacggagcctagtggtgccatgccgcaaccaggatgagcttatcggccgggccaggatctcccagggggccggctggtcactaagagagaccgcatgcctgggcaaagcctacgcccaaatgtggtcgctgatgtacttccaccgacgagacctccgtcttgcctcaatggccatctgcagtgccgtacccacggagtggttcccgaccagtaggacgacctggagcatacacgcgcaccatcaatggatgacgactgaagacatgctgaaagtgtggaatcgtgtgtggatcgaagacaaccccaacatgaccgataaaaccccagtccattcctgggaagacatcccgtatctcggcaagcgggaggacctgtggtgcggtagccttatcggactctcctccagggccacgtgggccaagaacatccacaccgcaatcacgcaagtgcgcaacctgatcggcattgaggagtacgtggattacatgccggtcatgaagcggtattcagcccccttcgagagtgagggggttctgtga

SEQ ID NO: 26235 - RNA, 9867 nt, synthetic construct
  misc_feature 1..9867: note = derived and/or modified CDS sequence (opt11) from DENV-4__JQ922558__SS-prME
  source 1..9867: mol_type = other RNA
tcaaccctcacccttctatgcctgattcctacggtgatggccttccacctgtcaactcgcgacggcgagccgcttatgatcgttgctaagcatgagcgcggccgtcccctgctattcaagactaccgagggcatcaacaagtgcacgctgatcgcgatggacctgggggagatgtgcgaggacaccgtaacctacaagtgccccctcctggtgaacaccgagcccgaggatatcgactgctggtgcaacctgacgagcacctgggtgatgtatgggacttgcacccagtccggggaacggcgccgggagaagcgtagcgtggccttaacgccgcactcaggcatgggcctggagacccgggcggagacctggatgagctccgagggggcctggaagcacgcacagcgggtggagtcttggatcctgcggaaccctggcttcgcgctcctggctggtttcatggcctacatgatcggccagaccgggattcagaggacggtgttcttcgtactgatgatgctcgtggccccctcctacggcatgcggtgcgtaggggtggggaaccgcgactttgtggagggcgtgagcgggggcgcgtgggtggacctggtgctcgagcacggcgggtgcgtcaccacaatggcccaggggaagcccacccttgactttgagctgattaaaacgacagccaaagaggtggccctgctaaggacctactgcatcgaggcctccatcagcaacatcactacggcgacccgctgcccaacccagggggagccttacctgaaagaggaacaggaccaacaatatatctgcaggcgcgacgtagtcgaccgggggtggggaaacggctgcggcctgttcgggaagggcggggtggtgacctgcgctaagttcctctgcttgggcaagattacggggaacctcgttcagatcgagaacctggagtacaccgtggtggtcaccgtccacaacggcgacacccacgccgtaggcaacgacatctccaaccacggggtaaccgctaccatcacgcccaggagcccctccgtggaggtcaagctgccggactacggagagctgaccttagactgcgagccccggagcgggatcgactttaatgaaatgatcctgatgaagatgaagaagaagacgtggctggtacataagcaatgggtgctcgacctgccactgccctgggccgcgggcgccgacacgtccaaagtccagtggaactacaaggagcgcatggtgaccttcaaggtgccgcacgcaaagcggcaggatgtcacggtgttggggagccaggaaggagccatgcactccgcattaaccggggcgacggaggtggacagcggggacgggaaccatatgttcgccgggcacctgaagtgcaaggtgcgcatggagaaactccgcatcaagggcatgagctacactatgtgctccggcaagttcagtatcgacaaagagatggccgagacccagcatgggaccacggtggtgaaggtcaagtacgagggcgctggggcaccctgcaaagtacccatcgagatccgggacgtgaacaaggaaaaggtcgtgggccgcataatctcctcgaccccctttgcggagcataccaactccgtgaccaatatcgagctggagccgccgttcggggacagttacatcgtcatcggcgtgggcgactccgccttaacgctccactggttccggaaggggagctcgatcggcaagatgttcgagagcacctaccgcggagccaagcggatggccatcctgggggaaaccgcatgggacttcggctccgtgggcggcctgttcacaagcttaggaaaggccgtccaccaggtcttcggctccgtgtacacgaccatgtttggcggagttagctggatggtgcgcatcctgatcggactgctggtgttgtggatcggtaccaactcccggaacaccagcatggccatgacgtgcattgccatcggcggaatcaccctgttcctgggcttcaccgtacacgccgacatggggtgtgctgtgtcctggagcggcaaagagctaaagtgcgggtccggcatcttcgttgtcgacaacgtacacacctggacggagcagtacaagttccagcccgagagccccgcccggctggccagcgccatcctgaatgctcacaaggacggcgtgtgcgggatccggtccaccacccgcctcgagaacgttatgtggaagcagatcaccaacgagctgaactacgtgctgtgggagggggggcacgacttgacggtggtcgccggcgacgtgaaaggcgtgctgaccaagggcaagcgggccctgacgccacccgtcaacgatttgaagtactcctggaagacctggggcaaggccaagatcttcacgcccgaggcccgcaactccacattcctgatcgacgggcccgataccagcgagtgcccgaacgagcggcgcgcctggaatttcctggaggttgaagactacggctttgggatgttcaccacgaacatctggatgaagtttcgggagggctccagcgaggtgtgcgaccaccgcttaatgtccgccgccatcaaggaccagaaggctgtccacgccgacatgggatactggatcgagagctccaagaaccagccctggcagatcggaaacgcgagcctgatcgaggtcaaaacctgtctgtggcccaagacccacaccctttggtctaacggcgtgctggagtcgcagatgctaattccgaaagcttacgccgggcctttttcacagcataactaccggcaaggctacgccacgcagacgatcgggccctggcacctcggcaagctggagatagacttcggggaatgccccggcactaccgtcaccatccaggaggactgcaaccatcgcggaccgagcctgcgaacgaccactgcctccggcaagctcgtaacccagtggtgctgtcgcagctgcacgatgccgcccttgcggttcctgggggaagatgggtgttggtacggcatggagattcggcccctctctgagaaggaggagaatatggtcaaaagccaggtcagcgcgggccaagggacctcagagacctttagcatgggcctactgtgtctcaccctgttcgtggaggagtgcctgcgccggcgcgtgacgcgaaagcacatgatcctcgtggtcgtcaccaccctgtgcgccatcatactcggtggcctcacctggatggacctgctgcgcgccctcatcatgttgggggatacaatgtctgggagaatgggaggacagatccatctgaccatcatggccgtgttcaagatgtcaccgggctacgtcctcggggtcttcctgcgcaagctgacctctcgggagactgccctcatcgtcatcggcatggctatgacgacggtgttaagcatccctcacgacctgatggagttcatcgacggcatctccctaggtttgatcctcctcaagatggtcgcccacttcgacaatacgcaggtgggcaccctggccctgagcttgacgttcatacgctccacaatgcctttagtgatggcctggagaactatcatggccgtcctcttcgtggtgacccttatccccctgtgccgcacgagctgcttgcagaagcaatcgcactgggtcgagatcaccgccctcatcttgggggctcaggccctgccggtgtacctcatgaccctcatgaagggtgccagcaaacggtcttggccccttaacgagggtatcatggctgtgggcctcgtcagcctgctggggtccgccctgctgaagaacgacgtgcccctggccgggcccatggtcgccggcgggctcctgcttgccgcgtacgtcatgtccggctcgagcgccgacctctccctggagaaggccgccaacgttcactgggacgaaatggccgacatcaccggtagcagcccgatcatcgaagtgaagcaggatgaggacggctccttctcaatccgcgacgtcgaggagacgaacatgatcaccttactcgtgaagctggcgctgatcaccgtgtcaggcctttaccccttagccattcccgtcaccatgacgctgtggtacatgtggcaggttaagacccaacgcagcggggccctctgggacgtgccctcccccgccgcggcgcaaaaggcgaccctgaccgagggcgtctaccgcatcatgcaacgtggtctgttcggcaagacccaggttggggtgggcatccatatggagggcgtctttcacaccatgtggcacgtcacgcgcgggagcgtgatctgccacgagaccggccgtctcgagccctcctgggccgacgtccgcaacgacatgatcagctacgggggcggctggcggctgggggacaagtgggacaaggaggaggacgtccaggtgcttgcgatcgagcccggtaagaacccaaaacacgtccagaccaagcccggactgttcaagacgctgacaggggaaatcggggccgtgaccttagacttcaagcctggcacctcaggaagccccataatcaacaaaaaggggaaggtaatcgggctctacgggaacggcgtagtgacgaagtccggggattacgtgagcgcgatcacgcaagccgagcgcatcggcgatccggattacgaggttgacgaggatatcttccgcaagaagcggctcacgatcatggatctgcacccgggcgccgggaagaccaagcgcatactcccctccatcgtgcgggaggccctcaagcgccgcctacgcaccctgatcctcgcgcccacccgggttgtcgccgccgaaatggaggaggcattacgcggattaccgatccgatatcagacacccgccgtcaaaagcgagcatacagggcgcgagatcgtggacctcatgtgccatgctacgttcactgccaacccactgtccagcacccgggtccccaactacaacctaatcgtgatggacgaggcccatctccaggatctgagtatcgtcgccgctcgcggctacataagcacccgggttgagatgggggaggctgcggccatcttcatgacggcaaccccgcccggcgccaccgacccctttccccagtcaaattcaccaatcgaggacatcgagcgcgagatcccagagcggagctggaacacaggcttcgactggatcacggactatcaggggaagaccgtgtggttcgtcccttccatcaaagcgggcaatgacatcgccaattgcctgcgcaagagcgggaaaaaagtgatccagctgtcccggaagaccttcgacaccgagtaccccaaaacgaagttgaccgactgggacttcgtggtcactaccgacatcagcgagatgggcgccaatttccgcgcccgccgcgtgatcgacccgcgccggtgccttaagccggtgatcctcacggacgggcccgagcgcgtaatcctggcgggtcccatcccggtgacacccgcctccgcggctcagcggcgaggccggatagggcgcaaccccgcccaagaggacgaccaatacgtgttcagtggggatcccctgaaaaacgacgaggaccacgcccactggaccgaagcgaagatgctcctcgacaatatctacaccccggagggaatcatccccacgctttttggccccgagcgggagaagatccaggccatcgacggcgagttccgcctacgcggggagcagcgcaagacgttcgtcgaactcatgcggcgcggcgacctgcccgtgtggttatcctacaaggttgcaagcgcggggatttcctacaaggatcgggagtggtgcttcaccggcgagcgtaacaaccagatcctagaggagaacatggaagttgagatctggacacgggagggggagaaaaagaagctgcgccccaagtggctcgacgcgagggtctacgccgaccccatggccctgaaagacttcaaggagttcgcctccggtcgtaaatcaatcacgctggacatcctcaccgagatagccagcctgccgacctacctatcctcccgggcgaagcttgcgctggacaacatcgtgatgctgcacactacggagcgcggcgggcgagcctatcagcacgctctcaacgagctgccggagagcctggagaccctcatgctggtagccctgctcggcgccatgactgctggaatcttcctattcttcatgcagggaaagggtatcggcaagcttagcatgggcctcatggccatagccgtggcgtccggcctgctgtgggtggccgaaatccagccccagtggatcgccgctagcatcatcttggagttcttctccatggctttgcttattcccgagcccgagaagcagcgcacacctcaggacaaccagcttatctacgtcatcctgaccatcttaacgatcataggtttaatcgcggccaacgagatgggccttatagaaaagaccaagactgatttcggattctaccaggtgaagaccgagacgaccatcctggacgtggacctccgccccgccagcgcctggaccctgtacgccgtcgcgaccacgatactgacccccatgctccggcacaccatcgaaaacaccagcgcaaacctctccctggccgccatcgccaaccaggcggccgtgctcatggggctgggaaagggctggcccttacacaggatggacctcggggtgccgctgctggccatgggctgctactctcaggttaaccccacaaccctcaccgcatctcttgtgatgctgtccgtgcactacgcaatcatcgggcccggcctccaggccaaggccacccgcgaggcacagaagagatccgccgcgggcatcatgaagaaccccacggtcgacggaatcaccgtgatcgatctagagccgattagctacgatcccaagtttgagaagcagctgggccaggttatgcttctggccctgtgcgccgggcagcttttgctgatgcggaccacatgggcgttctgcgaggtcttaactctggccaccggccccattctaaccctctgggaggggaaccccggcagattctggaacaccacgatcccagtgtccactgcgaacatcttccggggctcctacctggccggagccgggctcgccttctccctcatcaagaacgcccagacgccccgtcgggggaccggcacgaccggggagaccctgggtgagaagtggaaacgccagctgaactcacttgaccggaaggagtttgaggaatacaaacgcagtggaatcttcgaagtggaccgacacgagatcaagtacaccttaaaggacggaagcaagatcaaccacgcgatgtccaccggcagcatcaagatccgcggcatcgacgaacggggtatggtcaagcccaagggaaaggtcgtggaccaggggtgcggccgcgggggatggtcccactataccgccacggctaagaaggttaccgaggtgaaggggtacacgaaaggtgggcccggccacgaggagcccatccccatggccacctatggctggaacctggtgaagctccacagcggggtcgacgtgttctacaagcctactgagcaggtggacactctgctgtgcgacataggcgaatccagctccaaccccactatcgaggaggggagaactctccgcgtcctgaagatggtggaaccgtggctaagcagcaagcccgaattttgcatcaaagtgctcaacccctacatgcccaccgtcatcgaggagctggagaagctgcagcgaaaacacggcggctccctggtgcgctgcccgctcagccgcaattccacccacgagatgtactgggtgagcggggtctcgggcaacatcgtgagctccgtcaacaccacgagcaagatgctgctgaatcggtttacgacccgccaccggaagcccacctatgagaaagacgtggacctaggggcgggcacgcgctccgtgagtatcgagaccgagaaacccgacatgaccatcatcgggcggcgcctccagcggctgcgtgaagagcacaaggagacctggcactacgaccaggagaatccgtaccggacatgggcatatcacggctcctacgaagcccccagcacgggctccgctagctccatggttaacggggtggtgaagctcctgaccaaaccctgggatgtcatacccatggtgacacagctggccatgacggacaccacccctttcggccagcagcgcgagttcaaggagaaggtgtacaccagcacgccccaccccaagccctggactcggatggttatgacgaccacggcgaactggctctgggctctcgggggcaagaagaagtccccgcgcctgtgcacctgggaggaattcattagcaaggtgcggtccaatgccgccatcggggccgtgttccaggaggagcagggctggacctcagctagcgaggctgtcaacgactcccgcttctgggagctcgtcgacaaggagcgcgccctgcaccaagagggcaagtgcgagagctgcgtgtacaacatgatggggaagcgcgagaagaagctgggcgagttcgggcgggccaagggctcccgcgccatctggtacatgtggctcggtgcgcgtttcctggagttcgaggccctgggctttctcaacgaggaccattggttcgggcgcgagaacagctggtccggggtcgagggcgagggcctgcatcgcctggggtacatcctcgaggacatcgacaagaaggacggcgacctcatctacgccgacgacaccgccgggtgggacacgcgcatcaccgaggacgacctactcaacgaggagcttatcaccgaacagatggcgccccatcaccgcatcctggctaaggccatcttcaaacttacctaccactcgaaggtgatgaaagtgctacgccccacgccaaaaggggctgtcatggatataattagccgtaaggatcagcgggggagcggccaggtggggacctacggacttaacacctttaccaatatggaagttcaactcatccgccagatggaggcggagggcgtcatcacgcaggacgacatgcaaaatccgaaaggactgaaggagcgggtggagaaatggctgaaagaatgcggagtagaccgtctcaagcggatggctatctcgggggacgactgcgtcgtgaagcctctggacgagcgcttcagcacctccctcctgtttctgaacgacatgggcaaggtgcggaaagacattccccagtgggagcccagcaaggggtggaaaaactggcaggaggtccctttctgctcccaccactttcacaagattttcatgaaggacggacgcagcctcgtggttccctgccggaaccaggatgagcttatcggccgcgccagaatctcccagggggccggctggagtctgcgcgagaccgcctgcctggggaaggcgtacgcgcagatgtggtccctcatgtacttccaccggagagacctgcggttagcctctatggccatatgcagcgccgtcccaaccgagtggttccccacctcccgcacgacctggtccatccacgcccaccatcagtggatgaccaccgaggacatgctcaaggtgtggaaccgggtgtggatcgaggacaaccctaacatgacagacaagacccccgtccactcctgggaggacgtgccctacctgggcaagcgggaggacctgtggtgcgggtccctcataggcctgtccagcagggcgacctgggccaagaacatccacacagcaatcacccaagtgcggaacctgatcggcaaagaggagtacgtcgactacatgcctgtgatgaagcgctactccgcccccatcgagtcagagggggtgctgtga

SEQ ID NO: 26236 - RNA, 9867 nt, synthetic construct
  misc_feature 1..9867: note = derived and/or modified CDS sequence (opt11) from DENV-4__JQ922559__SS-prME
  source 1..9867: mol_type = other RNA
tccaccataacacttctatgcctgatacccaccgttatggcattccacctgtcaacgcgcgatggagaaccgctaatgatagtagctaaacatgaaagaggacggcccctactatttaaaaccacggaaggaataaataaatgcactttgatcgcgatggatctgggagaaatgtgcgaagacacggtcacctacaaatgccccctgctagtgaacaccgaaccggaagacatagactgctggtgcaacctaacgtcagcctgggtaatgtacggcacatgcacacaatcgggagaacggagaagggagaaaagatctgtcgcgctaacaccccacagtgggatgggccttgaaacacgggcggaaacctggatgtcctcggaaggcgcgtggaaacacgcgcaaagagtcgaatcctggatcctaagaaacccaggattcgccctgctggcagggtttatggcgtacatgataggccaaacaggcatacagcggaccgtattctttatcctgatgatgctagttgcaccaagctacgggatgcgatgcgtgggggttgggaaccgcgacttcgtagaaggggtgagcgggggtgcttgggtggatctagtcctcgaacacgggggctgtgtcacaaccatggcccagggaaaaccaaccctggacttcgaattaatcaaaactacagcaaaagaagtcgcgcttctacgaacatactgcatcgaagcatctatcagcaacatcactacggcaacacgctgtccaacccaaggcgaaccgtaccttaaagaagaacaagatcagcaatacatatgtcgccgcgatgtggtcgaccgcgggtggggcaatggatgcggccttttcggtaaaggtggggtagtaacctgcgcaaaattcctgtgctccgggaaaatcacgggcaaccttgtacaaatcgagaacctagaatacactgtggtagtaacggtacacaacggggacacccacgccgtaggtaacgatatctccattcacggtgtaacggcaacaatcacccctcgtagtccaagtgtagaagtaaagttgccggactatggcgaactaacactcgactgcgaaccacggagtggcatagatttcaacgaaatgatactcatgaaaatgaagaagaaaacctggctagtgcataagcaatggtttctcgacctacccctcccatggaccgcaggcgcggataccagcgaagtgcaatggaactacaaggaacggatggtaacgtttaaggttcctcacgcgaaacgccaggatgtaaccgtattaggatcccaagaaggcgcgatgcacagcgcgctcacgggcgcgaccgaagtagatagcggggacggcaaccacatgttcgcgggacacctaaagtgcaaagtgcgaatggagaagctgagaataaaagggatgagctacacgatgtgctcaggaaaattcagcattgacaaagagatggccgagacccagcacggaactacagtggttaaggtaaaatacgaaggggcgggggcgccctgcaaagttccgatcgaaatacgcgacgtcaacaaagagaaggtagtgggaagaataatcagctcaaccccgttcgccgaaaatacctactctgtgacaaacatcgagctagaaccaccgttcggagactcctacatcataatcggagttggggactccgcactcacgttgcactggttccgtaaaggatcaagcatcggcaagatgttcgagtccacgtaccgaggcgcaaagagaatggccatcctcggagaaaccgcatgggacttcggttccgtcggtggtctcctgacatctctggggaaagccgtacaccaggtattcgggagcgtctacacgactatgttcgggggcgtcagttggatggtgcgcatcctgattggattacttgtcctatggatcggaacgaactcgcgcaatacctccatggccatgtcctgcatcgcagtgggcggcataacgctattcctcggattcactgtccatgccgatatgggatgcgcagtatcctggtccggcaaggaactcaagtgcggcagtggaatcttcgttatagacaacgtccacacctggactgaacagtacaaattccaacccgagtcaccagcgcgactcgcatcagccattctgaacgcgcacaaggacggggtatgcgggatcagatccaccactagactggaaaatgtgatgtggaaacaaataacaaacgaactcaattacgtactatgggagggcggacacgacttgacaattgtcgcaggagatgtcaagggcgtcctatcaaaaggaaaacgcgcactcgccccgcccgttaacgacctcaaatactcatggaagacgtggggcaaagcgaagatcttcacccctgaaacgcgcaatagcaccttcctgatagatggcccagacaccagcgaatgcccaaacgaacgccgagcgtggaatttcttagaagtcgaagactatgggtttggaatgttcaccaccaacatctggatgaaattcagggaagggagctccgaagtctgtgatcacagactgatgtctgctgccattaaagatcagaaagcggtccacgctgacatgggatactggatcgaaagctccaagaaccagacatggcagatagaaaaagcctcgcttattgaggtcaaaacctgtctctggccgaaaacccataccctttggtccaacggcgtcctagaatcacagatgctgataccaaaggcctatgcgggaccgttttcacagcataactatcgacaaggctacgcaacacaaacggtgggcccctggcacctagggaaattagaaatagacttcggtgagtgccccggtaccacggtcactattcaagaagactgcgatcaccgcggaccctcactccgaactacaaccgcgtccgggaaactggtgacacaatggtgctgccggagttgtacgatgccacccctgcgctttctaggtgaagacggttgttggtatggaatggaaataaggcccctgagcgagcgagaagagaatatggttaaatcccaagtgagcgcagggcaaggtacatctgagaccttctcgatgggacttctttgcctgacgctatttgttgaggaatgcctgagaagaagagtaacccggaagcatatgatcctagtagtcgtcacaacgctatgcgccatcatcctcggcggcctcacttggatggatcttctcagagcactgataatgctaggtgataccatgagttcccgaatgggaggccaaatccatctagccataatggcagtgttcaaaatgtctcccgggtacgtcttaggcatcttcttaagaaagctgacatctcgcgagaccgccttaatggttatcggtatggctatgaccacggtgctatccatcccacatgaccttatggagtttatagatggaatttcgctcggcctcatcctattgaaaatggtgacccacttcgacaacacacagatgggaaccctagccctatcactaaccttcattaaatcgaccatgcccctcgtaatggcgtggcgaaccattatggccgtcctgttcgtggtgaccctaatcccactatgcaggaccagctgtctccaaaaacaatcgcattgggtcgaaatcactgccctgatattaggcgcacaggccttgccagtctacttgatgacactcatgaagggagcctcaaaaagatcttggccactgaacgaaggaatcatggcggtgggactcgtctcactactaggatctgcgctattgaaaaacgacgttcctctcgcaggacccatggtcgccggtggactcctacttgcagcatacgtcatgagcggctcgagcgcggacttatctctagaaaaggcggccaacgttcaatgggacgagatggcagacataacgggcagctcacccatcatagaggtaaagcaagacgaggacggcagtttcagcatccgagatgtagaagaaaccaatatgataacgctgctggttaagttagcactcataacggtttcgggcctatacccactcgctatccccgtcacaatgacgctctggtacatgtggcaagttaagactcaaaggagcggcgcattatgggacgttccgagtcccgcagctgcccagaaggcgacactaacagaaggcgtttacagaataatgcaaagaggcctattcgggaaaacacaggtcggggtcgggatacacatggaaggcgtgttccataccatgtggcacgtcacaagaggcagcgtcatatgccatgaaagcggaaggctcgaaccctcatgggcagatgtccggaatgatatgatcagctacggcggaggctggcgactaggagacaagtgggacaaggaagaagacgtgcaggtattagccatcgaacctggaaagaacccgaaacatgtacaaacgaagccagggctgttcaagacgctcacaggcgaaatcggtgccgtcacacttgactttaagcctggaacatcgggatcaccgattatcaaccgcaagggcaaagtgatcggcctgtatgggaatggggtcgtaaccaagagtggggactacgtgtcggcaatcacccaagctgagaggataggggagcctgactatgaagtagacgaagacatcttccggaagaagaggctcaccattatggacctgcaccccggcgccgggaagaccaaacgcattctgccaagtatcgtaagagaagcactcaagcgacgcctcagaacactcatattagcccccacccgcgtcgtagcagcagaaatggaggaggcgctgcgagggctacctataagatatcaaacccccgcagttctaagcgaacacaccggaagagaaatagtggaccttatgtgccacgccacctttacaactcgattgctcagctcaaccagagtgcccaactacaacttgattgttatggatgaagcccacttcacggacccgagtagcgtcgctgcccgtggatacatctccactagagtcgaaatgggagaggcagcagcaatattcatgactgcaacaccacccggtactaccgacccgttcccacaaagtaactcaccgatcgaagacatcgaacgtgaaatcccagagcgatcatggaataccggattcgattggataaccgattaccaaggcaagacagtctggttcgtgccatccatcaaggcaggcaacgacatagcaaactgccttaggaaaagcgggaagaaagtgattcaactgtcccgaaagacctttgacacggagtacccgaaaacaaaactaaccgactgggatttcgtggtaactacggatatcagcgtgatgggggcaaacttccgagcagggagagtaatagacccaaggaggtgcctcaaacccgtgataatcacagatggtccagaaagagtaatcctcgcaggtcccatcccggtcacaccagcgtcagcggctcagcgacgtggccgcataggcaggaatccggcccaagaagacgaccaatacgtcttctctggcgaccctctacgaaatgacgaggaccacgcccattggactgaggcaaaaatgttactagacaacatttacacgccagaaggcatcatacccacactcttcggacccgaacgagagaaaacacaagccatcgatggagagttccgactccggggtgagcaacggaagacatttgtcgaattaatgcggaggggtgacttgccagtttggctcagctacaaggttgcatcagcagggataagttacaaagaccgcgaatggtgcttcacaggagaacgaaacaaccagatactagaagaaaatatggaagtggaaatatggacccgtgaaggtgagaagaagaaactccgaccgaagtggctcgacgcaagagtttacgcggaccccatggctctgaaggacttcaaagagttcgcttcaggacggaagagtatcacccttgatatcctaaccgagattgcatcactgccaacatacctgagcagccgtgccaagctggcgttggacaacatagtaatgctgcatacgacggaaagaggcggaaaggcttaccagcacgcactcaacgaactaccagaatcgctggagactctcatgctagtcgcgctactcggagcaatgaccgccggcatcttcctattcttcatgcaaggcaagggcataggggaactaagcatgggcttaattgctattgcgggcgcatcaggcctgctatggggaacgaaaacacctccaccctggggagcggctagcaacatcctagagttcttcttgatggtgcttctgataccagagccagaaaagcaacggactccccaagacaaccaattaatatacgtgatattgaccatactaactatcataggattggtggcagcaaacgaaatgggtctaatcgagaaaacaaaaaccgatttcggattctaccaggtgaaaacagagaccacgatcctcgacgtagacctacgccctgcatccgcatggacattgtacgcggttgcgaccacaatattgacgccgatgctacgtcacaccatagaaaacacatccgcaaacttatcactggcagcaatcgcaaaccaggccgcggtactaatgggcctcggcaaaggctggccacttcatagaatggacctaggcgtgcccctcctcgccatgggatgttacagccaagtcaatccaaccacattgatcgcgtccctcgtgatgctcctagtacactatgcaataatcggcccaggacttcaagctaaagctaccagggaggcccagaagagaaccgctgccggtataatgaagaaccccactgtagacggaatcacggtaatcgatctcgaacccatctcatacgacccgaaatttgaaaaacaattaggacaggtcatgctcctagtgctgtgcgcagggcaactgttactaatgagaactacctgggctttctgtgaagtcctcaccctagcaacgggaccaatcctaacattatgggaagggaacccgggccgtttctggaacacaacaatagcagtaagcacggccaacattttccgcggaagctacctggcgggcgccgggctcgccttcagtctcatcaaaaacgctcagaccccaagacgaggaacgggcgtgacaggtgaaacccttggggagaaatggaaacgccaattaaattcactggaccgcaaagagttcgaagaatataaaagaagcggcatccttgaagtcgaccgaacggaggctaaatcggctctcaaggatggatcaaaaatcaaacaagccgtttcccgcggaaccagtaagattaggtggattgtagagcgaggaatggtgaaacctaaaggaaaggtcgtcgacctcggctgcggccgaggcggctggtcctactacatggcgaccctcaagaacgttactgaagtgaaaggctacacgaaagggggaccaggccacgaagaacccatcccaatggcaacatatgggtggaacttggtaaaactacactccagagtcgacgtattctacaagcccaccgagcaagtggacaccctactatgcgatatcggtgagtcctcaagcaaccctaccatcgaagagggacggacgctaagggtcctgaaaatggttgaaccgtggttatctagcaaacctgagttctgtatcaaggtccttaatccttacatgcccactgtaatcgaagaattagaaaaactccaacggaagcatggcgggtcgttagtccgctgtcctctcagccggaactccacacacgaaatgtattgggtgtccggtgtttcgggaaatatagtctcatccgtcaacaccacctcaaagatgctgctcaacagatttacgaccaaacaccgcaagccaacctatgagaaagacgcagacctgggagcgggcactcggagcgtatccaccgaaacagagaaaccagacatgacaatcattggcagacggctccagcgtctccaggaagaacaccaagaaacatggcactacgaccaagaaaatccctatcgtacctgggcctaccacggcggttacgaagcgccgagcactggcagtgcgagttcgatggtgaacggagttgtaaaactccttacgaaaccatgggatgtgatcccaatggtcacccaactggcaatgacggacacgacgccattcggacagcaacgcgtattcaaggaaaaagtagacacgcgaacaccacagcctaaacccgggacccggatggttatgacaacgacggcaaactggctctgggcgttactaggaaagaaaaagaacccaagactttgcacgcgcgaagagttcatcagtaaggtgagatccaacgctgccatcggggcggtctcgcaagaagaacaaggatggacaagttccttcgaggctgtgaacgacagcaggttttgggagttagttgataaggagagagccctgcaccaggagggaaagtgtgaatcatgtgtttacaacatgatgggaaaaagggagaagaaactgggcgagttcggcagagcgaaaggcagccgcgcgatttggtatatgtggctcggagctcgcttcctagagttcgaggccttggggttcttgaacgaggaccattggtttgggcgggaaaattcctggagtggggtggaaggagagggcctacatagactgggctacattctagaggacctagacaaacgcgaccgaagtctggtatttgcggacgacacagccggttgggacacaaagattcccgaagacgacctgctgaaagaaaaaccgattccaggaccgatggcacctcaccagcgtataccggcaagagcaatcttcaagctaacctatcaaaacaaggtagtcaaagtcttacggctaaagctaaagggagccgtaatggacataataagccgcaaggagcagcgaggctccggacaagtcggcacctacggactaaacaccttcaccaacatggaagttcaattaatccgacagatggaagcggaaggggtaatcacgcgagacgacatgcataacccaaaaggccttaaggaacgagtagaaaagtggttaaaggagtgcggcgtcgatcgccttgagaggatggcaatatcaggcgatgattgcgtagtaaagccactagacgagcgattcagcacctccttactgttcctaaacgacatgggcaaagtccgtaaagatatcccacagtgggaaccgtcaaaaggatggaaaaactggcaagaagtcccattctgctctcaccacttccacaaaatctttatgaaagacggacgcagcctcgtagtcccatgccgtaaccaagacgagctaatcggcagagcaaggatttcccagggggcaggctggagcctccgcgaaactgcctgcttgggcaaggcttacgcccagatgtggtccctgatgtactttcatcgacgagacctcaggctcgcctctatggcgatatgctcagcagtgccaaccgaatggttccctacctccaggacaacatggtcaatccacgctcatcaccaatggatgacgacagaggacatgctcaaagtatggaacagagtatggatcgaggacaaccccaacatgaccgacaaaaccccggtccactcgtgggaagacatcccgtacctaggaaagcgagaagacttgtggtgcgggagcctgataggtctcagtagccgagcgacatgggcaaagaacatacataccgccatcacccaagtacgaaatcttataggaatagaggggtacgtcgattactttctcctgatcaagtggtactcggcacccttcgagtccgagggcgtcctctag

SEQ ID NO: 26237 - RNA, 9867 nt, synthetic construct
  misc_feature 1..9867: note = derived and/or modified CDS sequence (opt11) from DENV-4__KF955510__SS-prME
  source 1..9867: mol_type = other RNA
agcaccattaccttactctgtctgatccccacggtgatggccttccacctctccacccgcgatggtgaaccgctcatgatagtggccaaacacgaacgggggcgccccctgctgttcaagaccaccgagggcatcaacaagtgtacgctcatcgcgatggacctgggggaaatgtgcgaggacactgtaacctacaaatgtcccctgctcgtgaacacggagcccgaggacatcgactgttggtgcaacctgaccagcgcctgggttatgtatgggacctgcacccagtccggggagcggcgccgggagaagcgcagcgtggcgctgacccctcactccggcatggggctcgagacgcggaccgagacctggatgagctccgaaggggcttggaagcacgcccaacgcgtggagagttggatcctgcggaagccaggctttgcgctttccgccgggtttatggcctatatgatcggccagaccggcatccagcgcacggtatttttcatcctcatgatgctggtggcccccagctacggcatgcgctgtgtgggggttggtaaccgcgacttcgtagagggcgtgtccggcggggcgtgggtcgatctggtgctagagcacggcgggtgcgtgacgactatggcacagggcaagcccacccttgacttcgagctgatcaagaccacggctaaggaggtcgccctcttgcggacctactgcatcgaagccagcatctcaaatataaccaccgcgacccgctgcccgacgcaaggggagccctacctgaaggaggagcaggaccaacagtacatctgtcggcgcgacatggttgacagaggctgggggaacgggtgcggactcttcgggaagggcggggtggtcacgtgcgccaagttcagctgctccggcaagataacggggaacttagtgcagattgagaacctcgagtacaccgtagtcgtgaccgtgcacaacggcgacacccacgccgtaggtaatgacacgagcaaccacggggaaacagccactataacccctcgctcccccagcgtggaagtccgcctcccggactatggggagctgacgctagactgcgagccccgtagcgggatcgacttcaacgaaatgatcctcatgaagatgaagaccaaaacttggctggtacacaagcagtggtttctggacctccccctgccctggaccgcgggagcggacacaagcgaggtgcactggaaccataaggagcgtatggtcacgttcaaggtcccacacgccaagagacaggacgtgaccgtcctgggcagccaggaaggagccatgcactccgcacttgcaggcgcgaccgaggtcgacagcggggacggcaaccacatgttcgccgggcacctcaagtgcaaggtgcgcatggagaagctgcgtatcaaggggatgtcctacaccatgtgcagcggcaagttcagcatcgacaaggagatggccgaaacgcagcacggcacaaccgtcgttaaggtgaagtacgagggcaccggggccccttgcaaggtccccatagagatccgcgacgtgaacaaggaaaaggtggtcggccggatcatctcgtctacccctttcgccgagaataccaacagcgtaaccaacattgagctagagccgcccttcggggactcctatatcgtcatcggcgccggcgacagcgccctgaccctgcactggttccgaaaggggtccagcatcggcaaaatgtttgagtcaacgtacagaggggcgaagcgcatggctatcctcggcgagactgcgtgggacttcggcagtgtcggcggcctcctgacctcactcgggaaggccgtgcaccaggtcttcggctcagtctacaccacaatgttcggtggcgtgtcctggatggtgcggatcctgatagggctattagtcctgtggatcggcaccaacagccgcaacacctccatggcgatgagctgcatcgtggtgggcggcatcaccctgttcctgggattcacagtacacgctgacatggggtgcgtggtgagctggtccggcaaagaacttaagtgcgggagcggcatcttcgtaatcgacaacgtacacacctggacggaacagtataagtttcagcccgagtcccccgcccggttagcgtcggccatactgaacgcccacaaggatggagtgtgcgggatacgctctaccacgcgcctcgagaacgtcatgtggaagcaaatcaccaacgagctgaactacgtgctgtgggagggtggtcacgacctcaccgttgtcgccggtgacgtcaagggcgtgctaagtaaagggaaaagagccctggccccgcccgtcaacgacctaaaatactcctggaagacctggggcaaggccaagatcttcacgccggagacccggaacagcaccttcctggtggacgggccggatacctccgagtgcccgaacgagcgccgggcttggaacttcctggaggtggaggactacgggttcgggatgttcacgaccaacatctggatgaaattccgggaggggagcagtgaggtctgtgaccaccggcttatgagcgccgccatcaaggaccaaaaggcggtgcatgccgacatgggatactggatcgagtccagcaagaaccaaacctggcagatcgagaaggctagtctgatcgaggtgaaaacctgcctatggcccaagacccacaccctatggagcaacggggtgctggaatcccagatgctgatcccgaaggcctacgcgggccctatcagccagcacaactatagacaggggtacgccacccagaccgtgggcccctggcacctcgggaagctggagatagactttggcgagtgcccgggcacaacggtgaccattcaggaggactgcgatcatcgggggcccagcctgcgcactaccacggcctcgggcaagctcgtcacccaatggtgctgccgcagctgcaccatgccgcccctgagattcctgggggaggacggatgctggtacgggatggagattcgccctctcaacgaaaaggaggagaacatggtgaagagtcaggtgagtgccggtcaaggcaccagcgagacgttctcgatggggctgctgtgccttaccttattcgtcgaggagtgtctgcggcgccgggtgacacgcaagcatatgattctcgtcgtggtgaccacgttatgcgccattatcttaggcgggctcacctggatggacctgctacgggctctaatcatgctgggggataccatgtccggccgcatgggaggccaaattcacctggccatcatggcaatgttcaagatgtcacccgggtacgtcctcggcatcttcctgcggaagctgacctcccgcgagacggccctcatggtgatagggatggcaatgacaaccgtgctttcaatcccgcatgaccttatggagttcattgatggcatctccctgggcctgatcctcctcaagatggtcacccacttcgataacacacaggtggggacactggcgctgtccctcaccttcatcaagtccactatgcccctggttatggcctggcggaccattatggccgtcctgttcgtcgtgaccctcatccccctgtgccgcacctcctgtctccagaaacagtcccactgggtcgaaattactgctctcatcctgggcgcccaagcgctgcccgtgtacctcatgacgcttatgaagggggccagcaaacggagttggcccctaaacgagggcatcatggccgtggggctcgtcagccttctgggctccgccctcctgaagaacgacgtacccctagcaggccccatggtggccggagggttactgctggcagcctacgtcatgagcggatcgtcggccgacctcagcctggagaaggcggcgaatgtgcaatgggacgagatggctgacatcaccgggtccagccccatcatcgaggtgaagcaggacgaggacgggagcttcagcatacgcgacgtcgaggagaccaatatgataaccctgctcgtgaagttagccttaatcacggtctccggactctacccgcttgctatccccgttaccatgaccctgtggtacatgtggcaagtgaagacccagcgaagcggcgcgctctgggatgtgccctccccagccgccgcccagaaggcgacgctgacggagggggcgtatcgcataatgcagcggggtctgttcggaaagacgcaagtcggcgtggggatccatatggagggcgtattccacactatgtggcacgtcacccgcggcagcgtgatctgccacgagtcagggcggctagagccgagctgggccgacgtgcgcaacgacatgatcagctacggcgggggctggcggctgggcgacaagtgggacaaggaagaggacgtacaggtgctggcgattgagcccgggaagaaccccaagcacgtgcaaacgaagcccggtctcttcaagaccttgaccggggagatcggcgccgtgaccctggatttcaaaccggggacgagcggcagtcccatcatcaaccgcaagggtaaggtgatcggcctctacggaaatggcgtggtcaccaaatctggcgactatgtaagtgctattacgcaggcggaacgcatcggggagcctgactacgaggtggacgaagacatcttcaggaagaagcgcctgacaatcatggacctgcatccgggggccggcaagaccaagcggatcttaccgtccatcgtccgcgaggccctgaagcggcgactgcgtaccctaattctcgcccccacccgcgtggttgcggccgaaatggaggaggccctgcgggggctgcccattcggtaccagaccccggccgttaagagtgaacacacgggccgggaaatagttgacttaatgtgtcatgccacctttaccacccgcctgctgtccagcacgcgggtgccgaactacaacctcatagtcatggacgaggcgcacttcaccgacccctcgagcgtggccgcccggggttacatctctacccgcgtagagatgggcgaggccgccgcgatctttatgactgccacaccccctgggaccaccgaccccttcccccagtccaactctcccatagaggacatagaacgcgagattccggagcggagctggaacaccggcttcgattggatcacggactaccagggcaagaccgtctggttcgtcccctccataaaggccggtaacgacatcgccaactgcctgcgcaagagcggtaagaaggtcatacagctgtccagaaagaccttcgacaccgagtaccccaagacgaaactcaccgattgggacttcgtagtgaccaccgatatcagcgaaatgggagccaacttccgcgcgggccgcgtcattgacccccggcgctgcctgaagccggtgatcttaactgacgggcctgaacgtgtgatcctcgcaggccccataccggttaccccggcgtccgccgcgcagaggcggggccgcatcggacggaatccagctcaggaggacgaccaatacgtgttcagcggcgaccccctgcgcaatgacgaggaccacgcacattggaccgaagccaagatgctgctagacaacatctacacccccgaagggatcatccctacgctattcggccccgagcgggagaagacccaggcaatcgacggcgagtttcgactcaggggcgaacagcggaagaccttcgtggagctaatgcggcgcggggacctgccagtctggctgtcctacaaggtggcaagcgccgggatctcttacaaggatcgggagtggtgctttaccggggagcgcaacaaccagatccttgaggaaaacatggaagtggagatctggacgcgcgagggtgagaagaagaagctgcgtcccaagtggctggacgcccgggtctacgctgaccctatggccctcaaggacttcaaagagttcgcgtcaggcaggaaaagcatcaccctggacatactgaccgagatcgccagcctccccacctacctaagtagcagagccaagctggccctcgacaacatcgtgatgcttcacaccacggagcgcggcggcaaggcctaccagcacgcgttgaacgagctccccgaaagcctggagaccctgatgttggtagccctgctgggcgccatgaccgccggaatctttctgttcttcatgcagggaaaggggatgggcaaactgtccatgggcctaatcgcgatcgccgttgcctcaggcctactgtgggtggcagaaatacagccgcaatggatcgccgcgtctatcatcctggagttcttcctcatggtgttactggtcccagagcccgagaagcagcgcacaccccaggacaaccagctcatctacgttatcctgacgatcctgaccatcattgccctcgtggccgccaacgagatgggcttaatagagaaaaccaagacagacttcggtttctatcaggcgaagacggagaccaccatcctggacgtcgatctacgcccggcgagcgcctggactctgtatgccgtggccactaccatcctaaccccaatgcttagacacaccatcgagaacacatccgcgaacctgtccctggcggcgattgccaatcaggccgccgtgttgatgggactggggaagggctggcctctgcaccgaatggacctcggcgtccccctgctcgcgatgggctgctactctcaagttaacccgaccaccttaaccgccagccttgtgatgctgctcgtccactacgccatcatcggccccgggctgcaggcaaaggcgacgcgcgaagcacagaagcggaccgccgccggcatcatgaagaatcctaccgtggacggcatcaccgtgattgacctggaacctatttcttacgacccgaagttcgagaagcagcttgggcaggtcatgctgctggtactctgcgccggccaattactcctcatgcggacgacctgggcgttctgcgaggtgctgacactggccaccgggccaatcttgacgctttgggagggcaaccctgggcggttctggaataccaccatcgctgtcagtactgccaatatcttcaggggctcctacctggcaggagcggggctcgcattttcactgatcaagaacgcccagacgcccagacgcggcacggggaccactggcgagacgctgggggagaagtggaagcggcagctcaattccctggatcgcaagggctttgaagagtataagcggagcggcatcctggaggtcgaccgcaccgaggccaaatccgccctcaaggacgggagcaagattaaatacgccgtgtcccggggcaccagcaagattcgctggatcgtggaacgggggatggtgaaaccgaaaggtaaggtggtcgacctggggtgtggccgcggcggctggtcctattacatggccactttaaagaatgtgaccgaggtgaagggctacacgaaagggggtcctgggcacgaggagcccatccccatggccacctacgggtggaacctcgtcaaactgcactcgggcgttgacgtgttctacaagccgaccgagcaggtcgacaccctgttgtgtgatattggggaaagctccagcaaccccacgatagaggagggccgtaccctgagagtgctgaagatggtggagccctggctctcctcgaaacccgagttttgcattaaggtcctgaacccgtatatgcctaccgtgatcgaggagctggagaagctgcagcgcaagcacgggggttctctggtccggtgccccctgagccgcaattccactcacgagatgtactgggtcagcggcgtgtccgggaacatcgtcagctccgtgaatacgaccagcaaaatgcttctcaaccgcttcaccaccaggcaccggaaacccacgtacgagaaggacgccgacctaggcgcaggaacccgcagtgtgagcacggagacagagaagccggacatgacgatcatcggccgccgcctgcagcggctccaggaggagcataaggagacctggcattacgaccacgagaacccgtatagaacctgggcctaccacgggtcctatgaggcccccagcaccggctccgccagctccatggtcaacggcgtggtgaaacttctgacaaagccttgggacgtcgttccgatggttacccagctcgctatgaccgataccacgccctttgggcagcaacgggtcttcaaagagaaggtggacacccgcacaccccagccgaagcctggtacccgggtggtgatgacgactaccgctaactggctgtgggcgctgctcgggcgcaagaagaacccccggctgtgcacccgcgaagagttcatctccaaggtgcggagcaacgccgccatcggcgccgtgttccaggaggaacaggggtggacgtccgcgagcgaagccgttaacgattctcgcttctgggagctggtcgataaggagcgggccctgcaccaggaggggaagtgcgagagctgcgtgtacaacatgatgggtaagcgcgagaagaagctgggggagttcggccgcgccaagggttcacgcgccatctggtatatgtggctaggtgcccgcttcctcgagtttgaagcgctaggtttcctaaacgaggaccactggttcggccgggagaacagctggtccggcgtcgagggtgagggattgcatcgcctggggtacatcctggaagatatcgacaaaaaggacggcgacttgatatatgcagacgatactgccggctgggacacacgcatcaccgaggatgacctgctgaacgaggagctcatcacggagcagatggcgccacaccacaagatcctagcgaaggccatcttcaagctgacgtaccagaacaaggtggtgaaggtcctccgcccgactcccaagggggccgttatggatattatcagccggaaggaccagcgcggctcgggacaggtgggaacctatgggttaaacaccttcacgaacatggaggtccagctgatccggcagatggaggcagaaggcgtgattacccgtgacgatatgcacaaccccaagggcctcaaagagcgggtggaaaagtggctgaaggagtgcggtgtcgaccgcctcaagcggatggcgatatcaggtgacgactgcgtggtgaagcccctcgacgagcgctttagtactagcttgctgttcctcaacgacatggggaaggtacggaaggacataccgcagtgggagccttccaagggctggaagaactggcaggaggtgcccttctgcagccaccactttcacaagatattcatgaaggacggtaggtcgctggttgtcccatgccggaaccaggacgagttaatcggcagagctcggatcagtcagggcgcagggtggtcccttcgcgagaccgcctgcctgggcaaggcttacgcgcagatgtggagtctgatgtatttccatagacgagacctccgcctggcgagcatggctatctgctctgcagtgcccacggaatggtttccaacaagccggaccacatggtccatccatgcacaccaccagtggatgacaacagaggacatgctgaaggtgtggaaccgcgtctggatcgaagataacccaaacatgatagataaaacccccgtgcacagctgggaggacatcccgtatctcgggaagcgtgaagacctgtggtgcggcagcttaatcgggctctcctcgcgcgcgacctgggccaagaatatccacacggccatcacacaggtgcggaacctgataggcaaagaggagtacgtcgactacatgccagtcatgaaacgctacagtgcccacttcgagtccgagggcgtgctctga

SEQ ID NO: 26238 - RNA, 9867 nt, synthetic construct
  misc_feature 1..9867: note = derived and/or modified CDS sequence (opt11) from DENV-4__GQ868594__SS-prME
  source 1..9867: mol_type = other RNA
agcaccatgaccctgctctgcttaatccccacggtcatggcgtttcacctgtcaacccgcgacggcgagcccctcatgatcgtggccaagcacgaacgcgggcgccccttgctcttcaaaaccaccgagggcatcaacaagtgcacgctcatcgccatggacctgggggagatgtgcgaggacaccgttacctacgagtgcccactgctcgtgaacaccgagcctgaggacatcgactgctggtgcaacctgaccagcgcctgggtgatgtacgggacatgcacgcagagcggggagcggcgccgagaaaagcgcagcgtggccctgacgccccactccggcatgggcctcgagacccgggccgagacttggatgagctccgagggggcctggaagcacgcgcagcgcgtggagagttggatcctgcggaaccccggcttcgctctgctcgccgggttcatggcgtacatgatcggccaaaccggtattcagcgcactgtatttttcgtgctgatgatgctggtggctcccagttacggcatgcggtgcgtgggggtcggtaaccgtgacttcgtcgaaggcgtgtcagggggggcctgggtggacctggtgctggaacacggcgggtgtgtcacgaccatggctcaaggcaagcccaccctggatttcgagctcatcaagaccacagccaaggaagtggccctgttgcggacctactgcatcgaggcatccatcagcaacatcacgacagccacgcgctgcccgacccagggagagccctacctaaaggaggagcaggaccagcagtacatctgccggcgcgacgtggtcgacagaggctggggcaacggctgcggcctgttcgggaaagggggggtggtgacctgcgccaaattctcctgcagcggcaagatcacaggaaacctggtccaaattgagaacctcgagtatacggtggtggtcactgtgcacaacggcgacacccacgccgtcggcaacgacatccccaaccacggggtgacggccacgatcacgcctcggtcccccagcgtcgaggtcaagctgcccgactacggggagctgaccttagattgcgaaccccgctccgggatcgacttcaacgagatgatcctgatgaaaatgaaaaaaaagacctggctggtccacaaacaatggttcctcgatctgcccctgccgtgggcggccggcgccgacacgagtgaagtgcactggaactacaaggaacgcatggttaccttcaaggtgccacacgccaagcggcaggacgtgatcgtcctcgggtcccaagagggcgccatgcacagtgcgttgaccggcgcgaccgaggtggacagtggtgatggcaaccacatgttcgccgggcatttaaaatgcaaagtgcgcatggagaagctccgcattaagggtatgtcctacaccatgtgcagcggcaagttttccatcgacaaggagatggccgagacgcagcacgggacgacggtcgtcaaggtgaagtacgagggcgctggggctccttgcaaggtcccaatcgagatccgggatgtgaacaaggagaaggtggtcggccgcatcatcagctccacgccgttcgcggagtacacgaacagcgtaaccaacattgagctggagccgccttttggggactcctacattgtgatcggcgtcggcgacagcgccctgaccttgcactggtttcggaaggggtccagcattggcaagatgctggagtccacctaccgcggggcaaagcggatggcgatcttaggcgagacggcgtgggacttcgggagcgtgggcggcctcctgacatccctggggaaggcggtgcaccaggtattcgggagcgtctataccaccatgttcgggggcgtttcctggatggtccgcatcctcatagggttcctggtgctgtggatcggaacgaactctcgaaatacctccatggccatgacctgtatcgccgtgggggggatcacgctgttcctcggatttacggtccacgctgacactgggtgcgccgttagctggtccggaaaggaactgaagtgcggttcgggcatcttcgttatcgacaacgtccacacctggaccgagcagtacaagttccagcccgaaagtccggccagactggcctcagccatactcaacgcgcacaaggacggtgtgtgcgggatccggagcacgacacgcctggagaacataatgtggaaacagatcaccaacgagctgaactacgtgctctgggagggcgggcacgacctgaccgtcgtggcaggcgacgtgaaaggcgtcctgtccaaggggaagcgagccctcgctccgcccgtgaatgacctgaagtacagctggaaaacgtggggcaaagccaagatctttacccccgaggcgaagaactccactttcctcatcgacgggccggacacgagcgagtgcccgaatgagcgccgggcgtggaacttcttagaggtggaggactacggcttcgggatgttcactaccaatatttggatgaagttccgcgagggctccagcgaggtctgtgaccacagattaatgtccgccgctataaaggatcagaaagctgtacatgccgacatggggtactggatcgagagctccaaaaaccagacgtggcagatagagaaggccagcctgatcgaggtgaagacctgcttgtggcccaagacgcacaccctatggtccaacggggttctggagagccagatgttaattccgaaggcctatgccggccctttctcacagcacaactatcgccaggggtacgcgactcaaaccgtgggcccctggcacctggggaaactggagatcgatttcggtgagtgccccggcacgaccgtgactatccaggaggactgcgatcaccggggcccgagcctccgcaccaccacggcctccgggaagctggtcactcagtggtgctgccggagctgcaccatgccgccacttcgctttctcggggaggacggctgctggtacgggatggagatccgccccctgagcgagaaggaggagaacatggtgaagtcccaggtgagcgccggccaaggcacctccgagacgttctcgatggggctgctctgtctcaccctgttcgttgaggagtgtctccggcgccgggtgacccgcaagcacatgatcctggtagttgtgaccacgctgtgtgccattatactcggcgggctgacctggatggatctgctccgggctttaatcatgctgggcgacacgatgtccggccgcatgggcgggcagatacatctcgcgatcatggccgtcttcaagatgagcccggggtacgtgctgggcatcttcctacggaagttgacctcccgcgagacggccctgatggtgatcgggatggctatgaccaccgtcctaagcatcccccacgacctcatggagttcatcgacggcatctcacttggcctaatcctcctgaaaatggtcacccacttcgacaacacacaggtcgggaccctggccctaagcctgaccttcatccgctccaccatgcccctggtcatggcgtggcgcacaatcatggccgtcctcttcgtggtaaccctgatccccctctgtcggaccagttgcctccagaaacagtcccactgggtggagatcaccgccctgatcctgggcgcccaagcgctcccggtgtatttgatgacgctgatgaagggcgccagcaagcgctcctggccccttaacgagggcataatggccgttgggctggtgagcctgctgggctccgcactgctgaagaacgatgtgcccctggccgggccaatggtcgcgggcgggctgttgctcgcagcctatgtgatgtcagggtccagcgccgacttaagcctggagaaggcagcgaacgtgcagtgggacgagatggccgacatcaccgggtcgagtccgatcatcgaagtcaagcaggacgaggacgggtccttcagcatccgggacatcgaggagaccaacatgatcactcttttggtgaagctggccctcatcacggtgtccggcctgtaccccctggccatccccgttacaatgaccctgtggtacatgtggcaggtcaaaacccagcgcagcggcgccctgtgggatgtgccctccccggcggccgcccagaaggccacgctgaccgagggggtctaccggatcatgcaacgcggcctcttcgggaagacacaggtgggcgtgggaatccacatggagggcgtcttccataccatgtggcacgtaacgcggggcagcgtaatctgccacgagacagggcgactggagcccagttgggccgacgtacgaaacgacatgatcagctacggcgggggctggcgcctgggcgacaagtgggataaggaggaagacgtgcaggtcctcgcgatagaacccggaaagaaccccaagcacgtccagaccaagcctggcctgtttaagacactgactggggaaatcggcgccgtgacgctcgacttcaagcccggaacctccggcagtcccatcatcaaccggaagggcaaggtcatcgggctgtacgggaacggggtcgtgaccaagtctggcgactacgtaagcgcaatcacccaagccgagcgcacgggagagccggactacgaggtcgacgaggacatcttccgcaagaagcggctgaccatcatggacctccatcctggagcgggtaaaaccaagcgaatcctaccgtccatagtgagagaagccctgaagcgccgtctaagaacactaatcttagcacccacgcgtgtggtcgccgccgagatggaggaggcgctgcgcgggctaccgatccggtaccagacccccgccgtcaagagcgagcacaccgggcgggaaatcgtggaccttatgtgccacgccaccttcacgacgcggctgctctcctctacccgcgtgcccaactacaatctgatcgtgatggatgaggcccacttcactgatccctccagcgtggccgcgcgggggtacattagcacgcgcgtggaaatgggcgaggctgccgcaatcttcatgaccgccaccccgcccggggcgaccgatcccttcccccaatccaactcgccgatcgaggatattgagcgggagatccccgagcgaagctggaatactggcttcgattggatcaccgactatcagggcaagacagtgtggttcgtgcccagcatcaaggccggcaacgatatcgccaactgcctgcggaagtcgggcaaaaaggtcatccagctatcgcgcaagaccttcgacacggagtaccctaagacaaagcttaccgactgggacttcgtggtcacaacggacatcagtgagatgggggctaacttccgggcgggccgcgtgatcgacccgcgcagatgcctgaagcccgtcattagcaccgacgggcccgagcgggtcattctcgccggcccgatcccggttacccccgcctccgccgcccagcggcggggccggatcgggcgaaaccccgcacaggaggacgaccagtacgttttcagcggcgatcccctgaagaacgacgaggaccacgcccactggaccgaagccaagatgctgctcgacaacatctacacaccggagggaataatcccaaccctattcggcccggagcgggagaagaaccaggccatcgatggcgagttccgcctgcgcggagagcagcgcaagaccttcgtcgagctcatgcgaaggggcgacctgcctgtatggctgtcctataaggtggccagcgcggggatctcctataaagaccgggagtggtgcttcacgggcgagcgcaacaaccagatcctcgaagagaacatggaggtcgagatatggacgcgggagggggaaaaaaagaaactgcgcccgaagtggttggacgcccgggtctacgccgaccccatggccctgaaggactttaaagagttcgctagtggccgcaagtccatcaccctggacatcctgacagagatcgcgagtctcccgacctacctgtccagccgggccaagctggccctagacaatattgtgatgttacacacaaccgaacgcggcggcaaggcctaccagcacgcgctgaacgagctcccggagtccctggagaccctgatgctcgtagccctgctgggcgctatgaccgccggaatcttcctctttttcatgcagggtaaggggatcggcaagttgagcatgggcctgatcgccatcgcggtggctagcgggctcctttgggtggccgagatccagccacagtggatcgccgcctccatcatattggagttcttcctcatggtcctgctcattcccgagcccgagaagcaaaggaccccgcaggacaaccagctcatatacgttattttaacgattctgaccatcatcggtctcatcgcggccaacgagatggggctgatcgaaaagaccaagaccgacttcggcttctaccaagtgaagacggagaccaccattttggacgtcgatctccgccccgcaagcgcctggaccttatacgccgttgcgacaaccatcctcaccccaatgctccgccacaccatagagaacacgtccgccaacctgtcactggcggccatagccaaccaggcggccgtgctcatggggttgggcaagggatggcccttgcaccggatggacctcggggtccccctgctggccatgggctgctacagccaggtcaaccccaccaccttaatcgctagcctggtgatgttgctcgtccactacgcgatcattggacccggccttcaagctaaggccacaagagaagcccagaaacggacagccgcgggcataatgaagaaccccaccgtggacgggataaccgtgattgatctcgagccgatctcctatgatcccaagttcgagaagcagctcggccaggtcatgctgttagtgctgtgcgccgggcagcttttgcttatgcgcaccacctgggcattctgcgaggtgttaaccctagccaccggccccgtcctcaccctctgggagggtaaccccggacggttctggaatacgaccatagccgtgagcaccgcgaacatcttccgcggcagctacttagccggggccggcctcgccttcagcctgatcaagaatgctcagaccccgcggcgcgggacgggcacaaccggtgagaccttaggagagaagtggaaacggcagctcaactccctcgaccgcaaggagttcgaggagtacaagcggagcggcatcctggaggtggaccgcaccgaggccaaatccgccctcaaggacggctctaagatcaaacacgctgtttcccgggggagctccaagatccgttggatcgtcgagcggggaatggtaaaacccaagggaaaggtagtggacctgggttgcggccgcggcggctggagctactacatggccaccctgaagaacgtgaccgaagtcaagggctacaccaaagggggccccggtcatgaggagcccatccccatggcgacatacggttggaacctcgttaaactgcacagtggcgtggacgttttctacaagcccaccgaacaggtagataccctcctctgcgacatcggggagagcagctcaaaccccaccatcgaagagggccggacactgcgcgtgctgaagatggtcgagccgtggctcagcagtaagccggagttctgcataaaggtactgaatccctacatgcccacggttatcgaggagctggagaaactccagcggaaacacgggggcagcctagtccgctgtcctctgtcgcgaaacagcacgcacgaaatgtactgggtgtcaggcgtaagtgggaacatcgtttccagcgtaaacaccacgtccaagatgctgctgaaccggttcacgacacgccaccggaagcccacctacgagaaggacgtagaccttggcgccgggacccgatccgtgtctacggagactgagaagcccgatatgaccatcattggccggcgcctgcagcggcttcaggaggagcacaaggagacctggcactacgaccaggagaacccttaccgcacgtgggcttaccacgggtcctatgaggcgccgtccaccggcagcgcgtccagcatggtgaatggagtcgttaagctactgacgaagccatgggacgtgatccccatggtcacgcaactcgcgatgacagacactactcctttcggacagcagcgggtgttcaaggagaaggtggacacaaggacgccgcagcccaagcccggtaccaggatggtgatgactaccaccgccaactggctgtgggccttgctcgggaagaagaaaaacccccgcctgtgcactcgggaggagttcatctccaaggtgcgttctaacgccgccatcggtgcggtgtttcaggaggaacaggggtggacctccgcctccgaggccgtcaacgatagtcggttctgggagttggtggacaaggagagagctctccaccaggaaggcaaatgcgagtcctgcgtgtacaacatgatgggcaagagggagaagaagttgggtgaattcggcagagccaaggggagccgcgctatctggtacatgtggctcggcgcccgcttcttggagttcgaggcactggggttcctgaacgaggatcactggttcggccgggagaattcatggtcgggcgtggagggggagggccttcacagactggggtacatcctggaggacattgacaaaaaggatggcgatttgatctacgccgacgacaccgcgggctgggacacacgcatcaccgaggacgacctgctgaacgaggaactgattaccgagcagatggccccgcaccataagatcctggctaaggccatctttaagctgacctaccagaacaaggtggtgaaggtcttgcggcccacgcccaagggggccgtgatggacatcatctcccgcaaggaccagaggggcagcggccaagtcggcacctacgggctgaacaccttcaccaacatggaggtccagctgatccggcagatggaggccgagggcgttataacccaggacgatatgcacaaccccaagggcctcaaggagcgagtggagaagtggctgaaggagtgcggggtcgaccgcctgaagcggatggccatctccggcgatgactgcgtagtcaagccgctcgacgagcgctttagcacctcactgctgttcctcaatgacatggggaaggttcggaaggacatcccccagtgggagccgagcaagggctggaagaactggcaggaggtccccttctgttcccaccacttccacaagattttcatgaaggatgggcgcagcctggtggtcccgtgccggaaccaggacgagctgatcggccgcgccaggatctcccaaggcgcagggtggtctctccgcgagaccgcctgtctgggcaaggcgtacgctcaaatgtggtctttaatgtacttccacaggcgcgatctccggctggccagcatggccatttgcagcgccgtcccaactgaatggttccctacgtcccgcacgacatggagcatccacgcccaccaccagtggatgacaacggaggatatgctgaaggtgtggaaccgggtctggatcgaggacaaccccaacatgacggataagacaccggtgcactcctgggaggacattccctatctcgggaagcgggaggacctttggtgcgggtcactgatagggctgagcagccgcgccacctgggccaagaacatccacacggctatcacgcaggtccggaatctgatcggcaaggaggagtacgttgactacatgccggtgatgaagcgctactccgccccctttgagtccgagggcgtgttgtga

SEQ ID NO: 26239 - RNA, 9867 nt, synthetic construct
  misc_feature 1..9867: note = derived and/or modified CDS sequence (opt11) from DENV-4__FJ024424__SS-prME
  source 1..9867: mol_type = other RNA
agcaccattaccctgctctgcctgattcctacggtgatggccttccacctgtccacccgcgacggcgagccgctcatgatagtagccaagcatgaacgggggcgccccctactcttcaagactaccgagggtattaacaagtgtactctcatcgcgatggacctgggggaaatgtgcgaggacaccgtgacctacaagtgccctctgctcgtgaacaccgagcccgaagacatcgattgctggtgcaacctgacttcgacgtgggtcatgtacggcacctgtactcagtccggggaacgtcgccgcgaaaaacgttccgtagcactgacgccccactccggcatgggcctagagacccgggcggaaacctggatgagctcggagggtgcctggaagcatgcccagcgcgtggagtcgtggatcctgcggaaccccggcttcgcgctgctggcagggttcatggcctacatgatcggccagaccgggatccagcgcaccgtcttcttcgtcctgatgatgctggtagcaccctcctacggtatgcggtgcgtcggcgtgggcaaccgagacttcgtggagggcgtcagcggcggcgcctgggtggacctcgtgctggagcacggcgggtgtgtaaccaccatggcccaggggaagcccaccctggacttcgagctcaccaaaaccaccgctaaggaggtggccctgctacggacctactgcatcgaggcctccatcagcaacattacaaccgcgacccgctgtccgacccagggggaaccctacctaaaggaagaacaggaccagcagtacatctgccggcgcgacgtggtcgaccggggctgggggaatggctgcgggctgttcgggaagggcggggtggtgacctgcgccaagttctcctgcagcgggaagataacagggaacctcgtccagatcgagaacctcgagtacaccgtggtggttaccgtgcacaacggcgacacgcatgccgtcggcaacgataccagtaatcacggggtgacaactacgatcacaccccggagcccctccgtggaggtcaagctgccggattacggcgagctgaccttggactgcgagcctcgctcaggtatcgacttcaacgagatgattctgatgaagatgaagaagaagacctggctggtgcataagcagtggttcctcgacctgcccctgccctggaccgccggggcagatacgtccgaggtgcattggaattacaaggagaggatggtgaccttcaaagtcccgcacgcgaagcggcaggacgtaaccgtcctagggagccaggagggcgccatgcacagcgcactggccggggccaccgaggttgactctggggacggcaaccacatgttcgcagggcacctgaagtgcaaagtgcgaatggaaaaactccgcatcaagggtatgagttacacgatgtgctccggtaagttctcaatagacaaagaaatggccgagacccagcacgggacaactgtcgtgaaggtgaagtacgaaggcgccggggccccctgtaaggtcccgatcgagatccgagacgttaataaggagaaggtggtcgggcgcgtgatatcgagcacgcccctggccgaaaacactaacagtgtgaccaacatcgagctggagccacccttcggggacagctacatcgtaatcggcgtgggcaactcggccctcacactacactggttccggaaggggagctccatcggcaagatgttcgagtcgacgtaccgcggtgccaagcggatggccatcctgggcgagaccgcctgggacttcgggtcagtgggcggcctcttcaccagcttggggaaagcagtacaccaggtgttcgggtccgtgtataccacaatgtttggaggcgtgtcctggatgatccgcatactgatcgggttcctcgtgctgtggatcggcacgaactcccgcaacaccagcatggccatgacctgcatagccgtaggcgggataacgctctttttaggcttcaccgtccaggccgacatggggtgcgtggtgtcctggagcggcaaggaactcaaatgcgggagcggaatcttcgttgtggacaatgtgcatacatggaccgagcagtataaattccagcccgagtcccccgcgcgcctggcatctgcgatactgaacgcccacaaggatggcgtgtgtgggatccgctccacgacccgccttgagaacgtgatgtggaagcagatcaccaacgagctcaactacgtgttatgggaaggcgggcacgacctcaccgtcgtggccggcgacgtgaagggcgtcttgaccaaggggaagcgtgccttaacaccgcccgtgagcgatctgaagtattcttggaagacatggggcaaggcgaagatcttcacccccgaggcaaggaactcaacttttctgatcgatgggcccgatacatccgaatgcccgaacgaacggcgcgcctggaacagcctggaggtggaagattacggctttgggatgttcacgaccaacatatggatgaagttccgggagggctccagcgaggtatgcgaccaccgcttaatgtccgccgccatcaaagaccagaaggcggtacatgccgacatggggtactggatcgagtcttccaagaaccagacgtggcagatcgagaaggccagcctgatcgaggtgaagacgtgtctttggcccaagacccacaccttgtggtccaacggagtcctggagagccagatgctgatacccaagtcctacgcagggccgttcagccagcacaactaccggcaggggtatgcgacgcagacggtggggccctggcacttggggaagctggagattgatttcggtgagtgccccggcaccacggtaaccatccaggaggactgtgaccaccgcgggcctagcctgcggacgacgacggcctccggcaaactcgtcactcagtggtgctgccggtcttgcactatgccgcccctgcgtttcctgggggaggacggttgctggtacgggatggagatcaggcccctctccgagaaggaggagaacatggtgaaatcacaggtcgccgcaggtcagggcacctccgagaccttcagcatggggctgctgtgtctcaccctgttcgtggaagagtgtctccgccggcgcgtgacgcggaagcacatgattctcgcggtcgtaattacgctctgtgcgatcattttgggcggtctcacctggatggacctcctgcgggccttaatcatgctgggagataccatgtccggccggatcggagggcagacgcacctggccatcatggcagtgtttaagatgagccccgggtacgtactcggcgtattcctgcgcaaactgacctcccgggagaccgctctcatggttatcgggatggcgatgaccactaccctgagcattccgcacgatctcatggagctcatagacggaatctccctgggtctaattctcctgaagatcgtaacccagttcgacaatacacaggtcggaacactggccctcagcctgaccttcatccggtccaccatgtcgttggtgatggcctggcggaccatcatggccgtcctcttcgtggtaacgctgatccccctgtgccgcacctcatgtctccaaaagcagagccactgggtcgagatcacggccttaatcctgggcgcgcaggccctccctgtgtacctgatgaccctgatgaagggcgcgtcccgccgaagctggcccctcaacgagggcatcatggccgtggggctggtctccctgctcggcagcgcgctgctgaagaacgacgtgccactcgctggtccaatggtggccggagggctcctgctcgccgcctacgtaatgagcggctccagcgcagacttgtcgctggagaaagctgccaacgtgcagtgggacgagatggccgatatcacgggcagctcccccatcatcgaggtgaagcaggacgaggatgggtcattctccatccgggatgtggaagagacgaacatgataaccctcctcgttaaactggcgctcatcaccgtgtcaggactgtaccccctggcgatcccagtcacgatgacgctctggtacatgtggcaagtgaagacccagaggagtggcgcactgtgggacgtgcccagtccggccgccacccagaaggccgcgttgtccgagggagtctatcggatcatgcagcgcggcctcttcgggaagacccaggtcggcgtggggatccatatggagggcgttttccacacaatgtggcacgtgaccagaggctcagtgatttgccacgagactgggcgcctggaaccctcctgggccgacgtcagaaacgacatgatcagctacggcgggggctggcgcctgggggacaaatgggataaggaggaggacgtacaggtgttagccatcgagccggggaaaaatcccaaacacgtgcagacaaagcccggactgttcaagacgctgaccggggagatcggcgcagtgaccctcgacttcaagcccgggacctccggaagccctatcatcaaccgcaagggcaaggtgatcgggctgtacggcaacggagtcgtgacaaagtccggcgactacgtatcagccatcacccaggccgagcggatcggggagcctgactacgaggtcgacgaggacatctttaggaagaagcgcctgacgatcatggacctccaccctggtgccggcaaaaccaagcgcatcctgccgtccatagtgcgggaggccctgaagcggcggttgcgcacccttatcctggcccccacaagggtggtcgcggcagagatggaggaggccctaagaggcctgcctatccggtaccaaacgcccgcagtgaaatcggagcacaccggccgcgagatcgtggacctgatgtgccacgcaacgttcactactcggctgttgagttccacccgcgtcccgaattacaacctgatagtgatggacgaggcgcacttcacggacccttcttccgtcgccgcccggggttatattagcactcgcgtggaaatgggcgaagccgccgcgatcttcatgaccgccacaccacccggggccacggacccgttccctcagtccaatagccccatcgaggatatcgagcgggagatccccgagcgctcctggaacaccggcttcgactggataaccgattaccagggcaagaccgtgtggtttgtcccgtcaatcaaagccgggaacgacatcgccaactgcttgcgtaaatctgggaagaaggtaatccaactcagccgtaagacgttcgataccgaatacccaaagaccaaacttaccgattgggatttcgtggtcaccacagatatctccgagatgggggctaacttccgtgccggccgggtgatcgatccacgccggtgcctgaagccggtgatcctcaccgacgggccggagcgagtcatcctggccggacccatcccagtgacaccggctagcgcagcccagcgccgaggacggattgggcgtaatccgacacaagaagacgaccaatacgtgttctccggcgacccactgaaaaacgacgaggaccacgcccactggaccgaggcgaagatgctcctggataacatctacactcccgaggggatcatccccaccctgttcggcccagagagggagaagacgcaggccatcgacggagaatttcgcctcagaggggaacagagaaagaccttcgtcgagttaatgcggcgcggagacctgcctgtgtggctcagctataaggtggcgtcagccggtatatcctacaaggaccgggagtggtgcttcaccggcgagcgcaacaatcagatactggaggagaacatggaggtcgagatctggacacgagaaggggaaaagaagaaattgcgcccccggtggctcgacgcccgtgtgtacgccgaccccatggcccttaaggacttcaaggagttcgcttccggcagaaagagcatcaccctggacatcctcacagagattgcctcactgccgacctacctgagcagcagagctaagctcgcactggacaacatcgtgatgctacacacgaccgagcgcggcgggcgtgcctaccagcacgccttgaacgaactgccggagtccctggagacgctcatgttggtggcattgctcggcgccatgaccgccgggatctttctgtttttcatgcaaggtaaggggatcggaaaactgagtatgggattaatcaccatcgccgtggcctccggactgctgtgggtggccgagatccagccccagtggatcgcagccagcataatcctcgagttcttcctgatggtcctgctcatcccggagcccgagaagcaaaggacgccccaggacaaccaactgatttacgtgatcctgacgatcctgaccatcatcggcctgatcgcggctaacgagatgggcttgatcgagaagaccaagactgacttcggcttctatcaagtgaagacggagaccaccatcctcgacgtcgatctgcggcccgcctccgcatggactttgtacgcggtggcgacgaccatcctcaccccgatgctgagacacaccatcgaaaacacgtcagccaatttaagcctggccgccatagccaaccaggcggcggtgctgatggggctgggcaagggctggcccctccaccgtatggacttgggggttcccctcctcgccatggggtgctacagccaggtgaatcccaccactctaacagcgtccttggtaatgctgctggtccattacgcaatcatcgggccgggtttgcaggcgaaggcgacacgcgaggcccagaaacggacggccgcgggcatcatgaagaatcccacagttgacggtatcaccgtcatcgacctcgagcccatatcctacgatcccaagttcgagaagcagctgggccaggtcatgctgcttgtgctgtgcgccgggcaactgctcctgatgcgcactacttgggccttctgcgaagtgttaaccctcgctaccggcccgattctgactctgtgggagggcaaccccggccggttctggaataccaccatcgccgtctcaaccgcgaacatcttccgcggaagttaccttgcaggggctggcctggccttctccttgattaagaacgcacaaacgcccagaaggggtaccggcactaccggggagactctcggggagaaatggaagcggcagctaaattcgctagaccgtaaagaatttgaggagtacaagcggtccggcattctcgaagtagaccgcacggaagcaaagagcgccctgaaggatgggtccaagatcaagcacgcagtgagccggggctccagcaagatcagatggatcgtcgaacgggggatggtgaagcccaagggcaaggtggtcgacctggggtgtggccgcggtggttggagctactacatggccacactgaagaacgtcacggaggtgaagggctatacaaaagggggcccggggcatgaggagccaatacccatggccacgtatggttggaacctggtcaagctgcacagcggcgtagacgtgttctacaagcccactgagcaggtcgacactctcctgtgcgatataggagagagctccagcaacccgaccatcgaggagggacggacgctacgagtgcttaaaatggtggagccatggctctcgagcaaacccgagttctgcatcaaggtcctaaacccctacatgcccaccgttattgaggaacttgagaagctgcagcgtaaacacgggggcaacttagtccgctgccccctgtccagaaactcaacccacgagatgtattgggtctcgggagcgagcggaaacatcgtttcctcggtcaacaccacgtccaagatgctcctgaaccgatttaccacccgccaccgtaagcccacatacgagaaggacgtggatctgggcgccgggacgaggagcgtgtccaccgagacggagaagccagatatgaccatcatcggccggaggctccagcggctgcaggaagaacataaggagacgtggcactacgaccaagagaatccgtatagaacctgggcctaccatgggagctacgaggccccatccactggctcggcgtcctccatggtcaatggcgtggtgaagctgctcaccaagccctgggacatgatacccatggtcacgcagctggccatgaccgacaccacccccttcgggcagcagcgcgtgttcaaggagaaggtggacacgcgcactccccagcccaaaccaggcacccggatggtcatgaccacgacggccaactggctgtgggccctcctgggaaagaagaagaacccgcgcctgtgcacccgggaggagttcatcagcaaggttcggtcaaacgccgccataggcgctgtgttccaggaggaacaaggctggaccagcgcctccgaggccgtaaacgacagccggttctgggagttagtcgacaaggagcgcgccctgcatcaggagggcaagtgtgaatcctgcgtatataacatgatgggcaagcgagagaagaagctgggagagttcggccgcgcgaagggcagccgcgccatctggtacatgtggttgggcgcgcggtttttagagttcgaggccctggggttcctcaacgaggaccattggttcggccgcgaaaactcctggtctggtgtcgagggagagggcctgcaccggctgggatatatactcgaggagatcgataagaaagacggcgatttgatgtacgccgacgatacggcaggctgggataccagaatcactgaggacgatctgcagaacgaggagctcatcaccgaacagatggcccctcaccacaagatcctcgcaaaggccatcttcaagttaacctaccagaacaaagtggtgaaggttcttagacccacacctcgcggggcggtaatggacatcatctcgaggaaggaccagcgcggctccgggcaggtcggcacctacgggctcaacacttttaccaacatggaagtccagctgatcagacagatggaggcagagggcgtgatcacgcaagatgacatgcaaaaccccaagggcttaaaggaaagggttgagaaatggctgagggagtgcggcgtcgaccgcctgaagcggatggccatcagtggggacgattgcgtggttaaacccctcgacgagagattcggcaccagcctgctgttcctcaacgacatgggcaaggtacggaaggacatcccccaatgggagccgtctaaggggtggaaaaattggcaggaggtgcctttctgcagccatcacttccacaagatctttatgaaggacggccgcagtctggtggtcccttgccggaaccaggacgagctgatcggccgagcccggatcagccagggcgccggctggtccctcagagagaccgcgtgcctgggtaaggcctacgcccaaatgtggagcctcatgtacttccaccgacgggacctccgcctggccagcatggccatctgcagtgcggtgcccacagagtggttccccacgagtcgcaccacttggtccatccacgcccaccaccagtggatgaccacggaggacatgcttaaggtgtggaacagggtgtggatcgaggacaaccctaacatgatcgacaagacccccgttcacagctgggaggacatcccctacctgggaaagcgggaggacctgtggtgcggctcgttgatcgggctcagctcccgcgccacctgggccaagaacatccacacagccatcacacaagtgcggaacctgatcgggaaggaggaatacgtcgactacatgcctgtgatgaagcgctacagcgcgccctccgaaagcgaaggggtactgtag

SEQ ID NO: 26240 - RNA, 9867 nt, synthetic construct
  misc_feature 1..9867: note = derived and/or modified CDS sequence (opt11) from DENV-4__EU854295__SS-prME
  source 1..9867: mol_type = other RNA
agcaccatcacgttgctctgtctgatccctacggttatggccttccacctatccacccgcgacggcgagccgctaatgatcgtcgctaagcacgaacgggggcgccccttactcttcaagaccaccgagggcatcaacaagtgcacgctcattgcgatggacctgggggaaatgtgtgaggacaccgtgacctacaagtgtcctctgttagtcaacacggagcccgaagacatcgactgctggtgcaacctgacgagcacctgggtcatgtacgggacctgtacccagtcaggggagcggcgtcgtgaaaaacgcagcgtggccctgacgccccactccggcatgggcctcgaaacccgggccgaaacttggatgagctccgagggggcctggaaacacgcccaacgcgtcgaatcttggatcctgagaaaccccggctttgcgctgttagccggcttcatggcctacatgataggccagaccgggatccagcgcacggtctttttcgtgcttatgatgctggtggccccttcctacggcatgcggtgcgtcggggtggggaaccgtgacttcgtggagggcgtgagcggaggggcgtgggtggacctcgtgctggaacacggcgggtgtgtgaccaccatggctcagggaaagcccacccttgactttgagctcacgaagaccaccgcgaaggaggtggccctgctgcggacctactgcatcgaggccagtatctctaacatcaccacggcgacccgttgccccacccaaggggagccctatctgaaggaggagcaggaccagcagtacatctgccggcgcgacgtcgtggaccggggctgggggaacggttgcggcctcttcgggaaaggcggggtggtaacttgtgccaagttctcctgcagcggcaagataaccgggaacctggtccagattgagaacctcgagtacaccgttgttgtcaccgtgcataatggtgacacgcacgccgtcggcaacgacacctccaaccacggggtgaccgccacgatcacgccccgcagcccctccgtggaggtcaaactaccggactacggcgagttaaccctcgactgtgaacctcggagtgggatcgatttcaatgagatgatcttgatgaagatgaagaagaagacctggctggtgcacaaacagtggtttctcgatctgccgctgccctggaccgccggcgcagacacctcagaagtgcactggaactacaaggagcgcatggtcacgtttaaggtgccacacgctaagagacaggacgtgaccgtgctcgggtcacaagagggcgccatgcattcggccctggcgggcgcgacggaggtggacagtggggacggcaaccatatgttcgcaggacacctgaaatgtaaggtgcgcatggagaagctccggatcaagggcatgagctacaccatgtgctccggtaaattctcaatcgataaggagatggccgagactcagcacgggaccaccgtcgtaaaggtgaagtacgagggcgccggggcgccctgtaaggtccccatcgagatccgggacgtgaataaggaaaaggtggttgggcgcgtaatcagctctacacccctggcggagaacacgaactccgtgaccaacatcgagctggagccgccgttcggagacagctacatcgtgatcggcgtgggcaactccgctctcacgctccactggtttcgcaagggttcttccatcggtaagatgttcgaatctacctaccgtggtgcgaagcggatggccatcttgggcgagacggcatgggacttcggatcagtgggcggcctattcacctctctggggaaggccgtccaccaggttttcggctccgtgtacacgaccatgttcgggggcgtcagctggatgatccgaatacttattgggttccttgtgctgtggatcggcacaaattcccggaataccagcatggccatgacctgcatcgcggtcggaggtataaccctgttcctgggcttcacggtccaagctgacatggggtgcgtggtgtcctggagcggccgcgaacttaagtgtggtagcggcatctttgtcgtggacaacgtacacacctggaccgagcagtacaagttccagcccgagtccccagcgcggttggcgagcgccatcctaaacgcccataaggacggcgtctgcggcatccgctccaccaccagactcgagaacgtgatgtggaagcagattaccaacgagctgaattatgttctgtgggaaggagggcacgacctcactgtggtggccggcgacgtgaagggcgtcctgaccaaggggaagcgcgccctgacgccgcccgtgagcgacctcaagtactcctggaagacctggggcaaggccaagatcttcaccccagaggcgagaaacagcacctttctcatcgatggacccgacacgtccgagtgtccgaacgagcgccgggcatggaacagcctggaggtggaggattatggctttgggatgttcaccaccaacatatggatgaagttccgtgagggctccagcgaggtctgcgatcatcgcctcatgtccgccgcgataaaggaccagaaggccgtgcacgcggacatggggtactggatcgagagctccaagaatcagacgtggcagatcgagaaggccagcctgatcgaggtgaagacgtgcctctggcccaagacgcacactctctggtctaacggcgtcctggagagccagatgttaatccccaaatcctacgcaggcccgttctcccaacacaattatcggcaggggtacgccacacagactgtgggcccctggcacctcggaaagctggagatcgacttcggagagtgccccggcacgacagtaaccattcaggaggattgcgaccaccgcgggcccagcctgcgcaccacgaccgcctcgggcaagctcgtcacccagtggtgctgccggagctgtaccatgccgcccctgcggttcttaggggaggacggctgttggtacgggatggagatccgccccctgtccgagaaggaggagaacatggtgaaaagccaggtcgccgccggccccggcacctccgagaccttctctatggggctgttatgcttaactctgtttgtagaggagtgtctgcggcgccgggttacccggaagcacatgatcttagctgtcgtgataacgctttgtgccatcatcttgggcgggctcacatggatggacctgttaagagccttgatcatgctgggcgacaccatgtccggccggattgggggccagacccacctggccatcatggccgtgtttaagatgtccccggggtacgtcctaggcgtgttccttcggaagctgacgtcccgagagaccgcgctcatggttatcgggatggcgatgaccaccacactgagcatcccccacgacctcatggagctcatcgacggcatctccctagggctgatccttctgaagattgtcactcagttcgacaacacccaggtggggaccctggccctctcgcttaccttcatacggtccaccatgagcctggtgatggcctggcgcactatcatggccgtcctcttcgttgtgactctgatccccctgtgccgtacgtcctgcctgcaaaagcaaagccactgggtcgagatcaccgcgctgatcctgggcgcccaagccctccccgtttatctgatgactctgatgaagggggcgtcccggcggtcatggcccctcaacgagggcatcatggccgtgggcctggtctctctgctcggctcggccttactgaagaacgacgtgcccctcgcgggccccatggtggccgggggcctactcttggcggcgtacgtcatgagcgggtccagcgccgacctgtctctggagaaagccgccaacgtccagtgggatgagatggccgacataaccggcagctcccccatcatcgaggtgaagcaggacgaagacgggagctttagtatacgcgacgtcgaagagacgaacatgatcaccctcctggtgaaactggcgctcataactgtgagcggcctgtacccgctcgcaatccccgtcaccatgacgctttggtacatgtggcaggttaagacccagagaagtggcgctttgtgggacgtcccgagcccggccgccacccagaaggcggccctttccgagggtgtgtacaggatcatgcagcggggactcttcgggaagacccaggtgggagtgggtatccacatggagggcgtcttccacaccatgtggcacgtgacgcgcggcagcgtgatctgccatgagaccgggaggctggaaccgtcctgggccgacgtccgtaacgacatgataagctacggcgggggctggcgcctgggcgacaaatgggacaaggaggaagacgtacaggtgttggccatcgagcccgggaagaaccccaagcatgtccagaccaagcctggcctgttcaagaccctgacgggggagatcggcgccgtgaccctcgacttcaagcccgggacctccgggtctcccatcatcaaccggaagggaaaagtgatcgggctatacggcaacggcgtagtgactaagtccggcgactacgtgagcgccatcacgcaggccgaacggatcggggagcccgactatgaggtcgacgaggacattttccgaaagaaaagactgactattatggacctccacccgggcgccggcaagactaagcggatcttgccatccattgttcgcgaggctttgaagaggcgattacggaccctcatcctggcaccgactcgggtcgtcgctgccgagatggaggaggcccttagagggctgcccatccgctatcaaaccccggccgtgaagtcggagcacactggccgggagatagttgacctgatgtgccacgccaccttcacgacacgcttactcagctccacccgcgtccccaactacaacctgatcgtgatggacgaagcccacttcaccgatccctcatccgtcgctgcccgcggttacatcagcacgcgcgtggagatgggcgaggcagcggccatcttcatgacagccacacccccgggcgccaccgacccctttccccagagtaactcacccatcgaggatatagaacgcgagatcccggagcggtcttggaacacgggcttcgactggatcactgactatcaaggtaagaccgtgtggttcgtccccagcattaaagcaggtaacgacatcgcgaactgccttcgcaagtccggcaagaaggtgatccagttaagccgcaagaccttcgacacggagtaccctaagacaaagctgaccgactgggactttgtggtgaccaccgatatctccgagatgggggccaacttccgggcaggccgcgtgatcgacccccggcgctgcctgaagccggttatcctcaccgacggtccggagcgggtaatcttggccggcccgatcccagttaccccggcaagcgccgcccagcgccgtgggcgcatcgggcgtaaccccgcgcaggaggatgaccagtacgtgttctcaggcgaccccctgaagaacgatgaggaccatgcccactggaccgaggcaaagatgctcctggacaacatctacacccccgaggggatcatcccgaccctcttcggccccgagcgagagaagacccaggccatcgatggtgagtttcggctccgcggggagcagcggaagaccttcgtcgagctgatgcgacggggcgatctgcccgtgtggctctcctataaggtggcatctgccgggatcagctataaggaccgcgagtggtgtttcacgggtgaaagaaacaaccaaatcctggaggagaacatggaggtcgaaatttggacccgcgagggggaaaagaagaagctgcggccccgttggctagatgcccgggtgtacgctgacccaatggcccttaaggatttcaaggagttcgccagtggccgcaagagcatcacgctggacatcctaaccgagatcgcctccctgcccacctacctgagtagccgcgccaagctagcgctagacaatatcgtgatgttgcatacaacggagcgtggcggccgcgcgtaccagcacgcgctcaacgagctgcccgagtctcttgagaccctcatgctggtcgccttgctcggtgcgatgacggcagggatctttctgttcttcatgcagggcaaggggattggcaagctgagcatgggcctcatcacgatcgccgtggcgtccggcctgctgtgggtggcagagatccagccgcagtggatcgcggccagcatcatcctcgagttcttcctgatggtcctgctcatccccgagcccgagaagcagcgaacaccccaggataaccagttgatctacgttatcctgaccatcctcaccatcatcggtctgattgctgccaacgagatggggctgatcgagaagacgaagaccgacttcggcttctaccaagtgaaaaccgagaccacgatcctcgacgtagacctgcgccctgcctcggcgtggaccctttacgccgtcgctaccaccatcctcacgcccatgctgcggcataccatcgagaacacctcagccaatctgtccctagccgctattgccaaccaagctgccgtgctgatgggactaggcaaaggctggcccctccacagaatggacctgggtgtacccctgctcgccatgggctgttacagccaagttaatccaaccacgttaacagcgtccctggtgatgctacttgttcattacgccattattgggcccggcctgcaggccaaggccacccgggaggcgcaaaagcgaacagcggccggtattatgaaaaaccccacggtcgacgggatcaccgtgatcgacctggagcccatctcctatgacccgaagtttgagaagcagctggggcaggtcatgctactcgtgctgtgcgctggtcaactgcttctgatgcgcaccacctgggctttctgtgaggtacttaccctagcgaccgggcccatcttgaccctgtgggaaggaaaccccggccgcttctggaacaccaccatcgccgtgtccaccgccaacatcttccggggatcgtatctcgctggcgccggtctggcgttctccttaatcaagaacgcccagacaccccgacgcgggaccggcacgaccggggagaccctcggcgaaaagtggaaacggcaattgaactccctggacaggaaggagttcgaggaatacaagagatccggcattctcgaggtggaccggaccgaggccaaatcagccctgaaggacgggtccaagatcaagcatgccgtgagtaggggctccagcaagatacggtggatcgtcgagcgcgggatggttaaaccaaagggcaaggtggtcgatctgggatgcggccggggagggtggagctattatatggctaccctcaagaacgtgacggaggtgaagggttatacaaaagggggccccggtcatgaggagcccatccccatggccacttacggatggaacctggtcaagctgcacagcggcgtggacgtgttctacaaaccgaccgagcaggtcgacacgctcctgtgcgacataggggagagctccagcaaccccaccatcgaggaagggcggactttgcgcgtactgaagatggttgagccctggctgtccagcaaacccgagttctgcataaaggtcctaaacccgtacatgcccaccgtgatcgaggagcttgaaaagctccagcggaagcacgggggcaacctggtccgctgtccactgtcccggaacagcactcacgaaatgtactgggtatccggcgccagcgggaacattgtgtcgagcgtgaacaccacctccaaaatgttgctgaatcgctttacgacccgccaccgcaaaccaacctacgagaaggatgtggacctgggagccgggacccgtagcgtgtccaccgagaccgaaaagcctgacatgaccataatcgggcgccgcctccaacggctgcaggaagaacacaaggagacatggcattacgaccaggagaacccctaccgaacatgggcataccacgggagctacgaggccccctcgacgggcagcgcgtcctcaatggtcaacggcgtggtcaaacttctaaccaaaccctgggacgtcattccaatggtgacccaacttgccatgaccgacacgaccccgtttgggcagcagagagtgttcaaagaaaaagttgacaccaggacaccccagccgaaacccggaacacgcgtggtgatgacaaccaccgccaactggctctgggctctcttagggaagaagaagaacccccggctgtgcacgcgcgaggagttcataagcaaggtccggtccaacgccgcaatcggtgccgtgttccaggaagaacaggggtggaccagcgcttccgaggcagtgaacgacagccgcttctgggaactcgtcgacaaggagagagcccttcaccaggagggcaagtgcgagtcctgcgtatataacatgatggggaaacgcgagaaaaagctgggggagttcggccgcgccaaagggagccgggctatctggtatatgtggctcggcgcacgcttcctggagttcgaggccctggggtttcttaacgaggaccactggttcggccgggaaaactcgtggagtggcgttgagggcgagggcctgcaccgcctggggtatatcctcgaggagatagataaaaaggatggggacctaatgtacgcagacgacaccgcgggttgggacacccggatcacagaagacgacctgcagaacgaggagctcataaccgagcagatggcaccccaccacaagatcctggcaaaggccatcttcaaacttacctaccagaacaaggtggtaaaggtgctccgcccgacacccagaggggccgttatggacataatatcgcgaaaggaccagagaggcagcgggcaggttggaacctacgggctgaacacgttcacgaacatggaggtgcagctcatccgccagatggaggccgaaggagttataacccaagacgatatgcagaaccccaaagggctcaaggagcgggtagagaagtggcttcgcgagtgcggtgtagaccgtctgaaacgcatggccatctcgggcgacgactgcgtcgtgaaaccccttgacgagcggttcgggaccagcttactgttcctgaacgacatgggcaaggtgcgcaaggacattccgcagtgggagccctccaagggctggaaaaactggcaggaggtccccttctgcagccaccacttccacaagattttcatgaaggacggccggtcccttgtggtgccgtgccgcaatcaggacgagctgataggccgggcgcgcataagccaaggggccggctggtccctccgcgagacggcctgcctagggaaagcctacgctcagatgtggtccctgatgtacttccacagacgcgacttacggctggcaagcatggccatctgctccgccgtcccgaccgagtggttccccactagccgcaccacgtggtccatccacgcccaccaccagtggatgaccaccgaggacatgctgaaggtttggaatcgagtttggatcgaagacaacccgaacatgatcgacaaaaccccggtccatagctgggaggacatcccgtatctcggcaagcgcgaagacctctggtgcgggtccttgatcggcctcagctcccgggccacgtgggcaaagaacatccacaccgctataacccaggtgcggaacctgatcggcaaggaggagtacgtggactacatgcccgtcatgaagcggtactcagcccccagtgagtcggagggggttctgtga

SEQ ID NO: 26241 - RNA, 9867 nt, synthetic construct
  misc_feature 1..9867: note = derived and/or modified CDS sequence (opt11) from DENV-4__EU854296__SS-prME
  source 1..9867: mol_type = other RNA
agcaccatcaccctgctctgtttgatccccactgtgatggccttccacctgtccaccagagacggcgagccgctgatgatcgtcgccaagcatgagcggggccgccccctgctgttcaagactactgagggcatcaacaagtgtacgctcatcgcgatggatctgggggaaatgtgcgaggacaccgtgacctacaagtgtcccctgctcgtgaacaccgagccagaggatatcgactgctggtgcaacctgacgagcacctgggtcatgtacggcacctgtacacagtccggggagcggcgccgggagaagcgcagcgtggccttaacgccgcactcaggtatgggcctcgaaacgcgtgctgagacctggatgagttccgagggggcctggaagcacgcccaacgcgtggagagctggatactacggaacccaggctttgcgctgttggccgggttcatggcttacatgatcggccagaccggtatccagcgcacggtcttcttcgtgctgatgatgctggtggccccctcctacggcatgaggtgcgttggcgtggggaaccgcgacttcgtcgaaggcgtgagcgggggcgcgtgggtggacctcgtgctggagcacggcgggtgcgtaaccaccatggcccaggggaagcccactctggatttcgagctcacgaagaccaccgcaaaggaggtcgcactgctgcggacctactgcatagaggcctccattagcaacattacgaccgccacccgctgccccactcaaggggagccctacctcaaggaggagcaggatcaacagtacatctgccggagggacgtagtcgaccggggctgggggaacggctgcggcctgttcgggaaaggcggggtggtgacgtgtgcaaaattttcctgcagtggcaagatcacggggaatctggtccagatcgagaacctggagtataccgtggtggtcaccgtgcacaacggagacacgcacgccgttggcaacgacacctccaaccatggggtgaccgccaccatcaccccgcgcagcccctccgtggaggtcaagctgccggactatggggagctgaccctcgactgtgaaccccgtagcggcatcgatttcaacgagatgatcttgatgaagatgaagaaaaagacctggctggtgcacaagcagtggttcctggacctgcctttgccttggacagccggtgcggacacctccgaggtgcactggaactacaaggagagaatggtcactttcaaggtgccgcacgctaaacggcaggacgtgacagtcctgggaagtcaggagggtgccatgcatagcgccctggccggcgccaccgaggtggactcgggagacgggaaccatatgttcgccggtcatctgaagtgcaaggtgcgcatggagaagctccggatcaaaggcatgagctacaccatgtgctccggcaagttcagcatagacaaggagatggccgagactcagcacggtaccaccgtcgtgaaggttaagtacgagggtgctggggctccctgcaaggtgcccattgagataagagatgtgaacaaggagaaagtggtcgggcgcgtgatctccagcacccccctggctgagaacacgaactccgtgactaacatcgagctggaaccgcccttcggagacagctacatcgtcatcggcgtgggcaactccgccctcaccctccactggttccggaaggggagctccataggcaagatgttcgagagcacatacagaggcgccaagcggatggccatcctgggcgagacggcgtgggacttcggatccgtgggcggcctcttcaccagcctggggaaagctgtccaccaggtgttcggctcggtgtataccaccatgttcgggggcgtcagctggatgatccgcatcctgatcggttttttagtgctgtggatcggcaccaactcacggaacaccagcatggccatgacctgcatcgctgtgggcgggatcacccttttcctgggcttcacggtccaggccgatatggggtgcgtggtgtcctggagcggccgcgagctcaagtgcgggtctggcatcttcgtcgtggacaatgtgcacacctggaccgaacagtacaaattccagccagagtcccccgcgcggctagcctcggccatcctaaacgcccacaaggacggcgtctgcgggataagatccaccacgcggttggagaacgtgatgtggaagcagatcacaaacgagctgaactatgtgctgtgggagggcgggcacgatctcaccgtcgtggccggcgatgcgaagggcgtgctgaccaaaggtaaacgagccctgacgccgcctgtcagcgacctcaagtactcctggaagacctggggcaaggccaaaatcttcacccccgaggcccggaacagcaccttcctgatcgacggacccgacacgtccgagtgcccgaacgagaggcgggcctggaattccctggaagtggaggactacggcttcgggatgttcaccaccaacatctggatgaagttccgcgagggctccagcgaggtatgcgatcaccggctcatgtccgcggctatcaaggaccagaaggccgtgcacgccgacatgggctattggatcgaaagttccaagaaccagacctggcagatcgagaaggcgagcttaattgaggttaaaacgtgtctctggcccaagacccacaccctctggtccaacggggtgctggagagccagatgctgatccccaagtcctacgccggcccattcagccagcacaactaccgccaggggtatgcgacccagaccgtcggcccgtggcacctcggcaagctggagatcgacttcggcgagtgccccggcacgacggtgaccatccaggaggattgtgaccaccgagggcccagcctgcgcaccacgaccgcttctggcaaacttgtgacccagtggtgctgccgaagctgcaccatgccgcccctgcggttcttaggcgaggacgggtgctggtacggcatggaaataaggccactctccgagaaggaggaaaacatggtcaaaagtcaggtcaccgccggccagggcacctccgagaccttctcgatgggcctgctgtgccttaccctgttcgtcgaggagtgcctgaggagacgagttacgcgcaagcacatgattctcgcggttgtcatcaccctgtgtgccatcatactgggcggactcacctggatggacctgctgcgggcccttatcatgctgggcgacacgatgtccggccgcatagggggccaaacgcacttggccataatggccgtgttcaagatgagccccggatacgtgttaggcgtcttcctccggaagctgacctccagagagaccgcgcttatggtgatcgggatggccatgaccactactcttagcatcccgcacgacctgatggagctcattgacggcatctccctgggattaatcttgctgaagatcgtgacccaattcgacaacacccaggtcggcacgctggccctcagccttaccttcatccggtccaccatgagcctggtgatggcctggcgaaccataatggccgtgctcttcgtcgtgacgctaatccccctgtgccgcacctcctgtctccagaagcagagccattgggtagagatcaccgccctgatcctaggcgctcaggccctccctgtctacctgatgaccctgatgaagggggcctcccgccgaagctggcccctaaacgagggcatcatggccgtggggctcgtctccctgctcggcagcgccctgctgaagaatgacgtcccgctcgcaggccccatggtcgccgggggcctgctgctcgccgcgtacgttatgagcgggtccagcgccgatctgtccctggagaaggccgccaacgtccagtgggacgagatggccgatatcacgggcagctcccccatcatagaggtgaagcaggacgaggacgggtccttctcgatccgggatgtggaggagacaaacatgatcacactcctggtaaagctggcgctcatcaccgtaagcggcttgtaccccctggccatcccggtcacgatgaccctctggtatatgtggcaggtcaaaacccaacggagcggcgcactgtgggacgtgcccagccccgcagccacccagaaggcggcgctgagtgagggggtataccgcatcatgcagcggggcctcttcgggaagactcaggtaggcgtggggatccacatggaaggcgtcttccacacaatgtggcacgtcacccgcggcagcgtgatctgccacgaaaccgggcggttggagccctcctgggctgacgtgcgcaacgacatgatcagctacggcggcggctggcgcctgggcgacaagtgggacaaggaggaggacgtccaagtgttagccatcgagccggggaagaaccccaagcacgtgcagaccaagcccggactgttcaagacgctaaccggggagattggcgccgttacgctcgacttcaagcccggaacctccggctcaccgatcatcaaccgaaagggtaaggtgattgggctgtacggcaacggggtcgtcacgaagtccggcgactacgtgagcgcgattacccaagccgagcgcatcggggagccagactacgaggtggatgaggacatcttccggaagaagcgtctgaccatcatggacttgcaccctggcgccggcaaaaccaaacggatcctgccgtccatcgtccgcgaggccctgaagcggcgcctgcggacgctcatattggcgcccaccagagtggtggccgcggagatggaggaagccctgcggggattgcccatccgctatcagacccccgcggtcaaaagcgagcacaccggccgggagatcgtggacctgatgtgtcacgcgacgttcaccacgcgcctgctcagctccacccgggtcccaaattacaacctgatcgtcatggacgaggcccatttcactgatcccagctccgtcgccgcccgcggatacatcagcacccgggtcgagatgggcgaggcggcggccatcttcatgaccgccaccccccccggtgccacggacccgttcccccagtcgaacagccctatcgaggacatcgagcgcgagatccccgagcggtcttggaacaccggcttcgactggatcaccgactaccagggcaagactgtgtggttcgtgccgtcgatcaaggccggaaatgacatcgcgaactgcctgcgcaagtccggtaagaaggtcatccagctcagcagaaagaccttcgacacggagtaccccaaaaccaagctgacggactgggacttcgtggtgacgacagacatctccgaaatgggggccaacttccgggccggccgcgttattgacccgcgccgctgtcttaagccagtgatactcacagacggtccggagcgggtcatactggccggccctatcccggtaactcccgcgagtgcggcccagcgccggggccgcatagggcggaaccccgcccaagaggacgaccagtacgtattctccggcgaccccttgaagaacgatgaggatcacgcccactggacggaggcgaagatgctcctcgacaacatctacacccccgaggggatcatccccaccctgttcggtccagaacgcgagaagacgcaggccatcgatggtgagttccggcttaggggggagcagcggaagactttcgttgagctgatgcgccggggcgacctgcccgtctggctatcgtacaaggtggcctccgccgggataagctacaaggaccgcgagtggtgtttcacaggcgagcggaacaaccagattttagaggagaatatggaggtggagatctggacccgcgagggggagaagaagaagttgaggcccaggtggctcgatgcacgggtatacgcggaccccatggccttgaaggactttaaggagttcgcctccggccgcaagagcatcacgctggacatcctaaccgagattgcctccctgccgacgtacctaagcagcagggccaagctcgcgctggacaatattgtgatgctccacaccaccgagcggggtggccgcgcctaccagcacgccctaaacgagctgcccgagtccctcgagaccttgatgctggtggccctgctcggcgcgatgacggcggggatcttcctgttctttatgcagggcaaggggatcggcaaattgagcatgggcttgatcaccatcgccgtcgcctccgggctgctgtgggtggccgaaatacaaccccagtggatcgcagcaagcattatcctcgaatttttcctgatggttctgctcatcccggaaccagagaagcagcgtacccctcaggacaaccagctgatctacgtcatcctgacaatcctcactatcatcggcctgatcgccgccaacgaaatggggctgatcgagaagaccaagacggactttgggttttaccaggccaaaaccgagacgaccatcctcgacgtcgatttacgccccgcttccgcttggaccctgtacgccgtggccaccacaatcctcacgccgatgctacgccacaccatcgagaatacctccgccaacctctccctagcggcgatcgcaaaccaggccgccgtcctgatggggctaggcaaagggtggccgctccaccgcatggacctaggggtgcctctgctcgcgatgggctgctacagccaagtgaaccccacgaccctcaccgcctcgctcgtcatgctcctggtgcactatgcgatcatcgggccgggcctgcaggccaaagccactcgggaagctcagaagagaactgccgccggcatcatgaagaatcccaccgtggacggcatcaccgtcatagacttggagcccatcagctacgatcccaagttcgagaagcaattgggccaggtgatgctcctcgtactgtgtgccgggcagctactcctgatgcggaccacgtgggctttctgcgaggtactgaccctcgccaccggccctatcttaaccctgtgggaggggaaccccggccgcttctggaacactaccatcgccgtgtctaccgccaacatcttccggggcagctacctcgccggggccggcctggcattctccctaatcaagaacgcccagacgccacgccgggggacgggcaccattggggagacactcggcgagaagtggaagagacagctgaatagcctggatcgcaaagaattcgaggaatacaagcgctccggtatcttagaggtggaccggaccgaggcgaagagcgccctgaaggacgggtccaagatcaagcacgcggtcagtcgcggatccagcaagatccggtggatcgtcgaacgcgggatggtaaagcccaagggcaaagttgtagacctaggctgcggccgcgggggctggtcatactacatggccactctcaagaacgtaacggaggtgaagggctacacgaaggggggtcctggacatgaggagcccatccccatggccacctacggctggaacctggtgaagctgcactcaggcgtggacgtcttctaccggcccaccgagcaggtggacacgctcctgtgcgacatcggggaaagctccagtaacccaaccatcgaggagggccgcaccctgcgggtgctcaagatggtggagccctggctgtctagcaagccggagttctgcatcaaggtgctgaacccctatatgccgaccgtgatcgaggagctggaaaagctccagcggaagcacgggggcaacctggtacggtgcccactgtccaggaacagcacgcacgaaatgtactgggtgagcggcgccagcgggaacattgtctcctcagtgaacacaacctccaagatgctcctgaatcggttcaccactagacaccggaagcccacctatgagaaggatgtggacctgggcgcaggaacccgctctgtctccaccgagaccgagaagccggacatgaccataatcggccgtagactccagaggttacaggaggagcacaaggagacctggcactacgaccaggagaacccgtaccgcacatgggcctatcacgggagctatgaggccccctcgacgggcagcgcctccagcatggtgaacggtgtggtcaagttgctcaccaagccgtgggacgtgatcccaatggttacccagctcgcgatgaccgacacgacccccttcggccagcaacgggtcttcaaggagaaggtcgacactcgaacgccgcagcccaagccgggcacgcggatggtgatgaccaccacagcgaactggctgtgggccctcctggggaagaagaagaacccccgcttatgcacgcgggaggagttcatcagcaaggtccgctccaacgccgctatcggcgccgtgttccaggaggagcaagggtggaccagtgcatccgaagccgtgaatgacagccggttctgggagcttgtcgacaaggagagagctctgcaccaggagggtaagtgcgaatcctgcgtgtacaacatgatgggcaagcgcgagaagaagctaggggaattcggccgggccaagggatcgcgggccatctggtacatgtggctcggggctcggttcctggagttcgaggccctggggttcctcaacgaggaccactggttcgggcgcgagaactcctggagcggcgtggagggggagggcctgcacagactggggtacattctcgaggagatcgacaagaaggacggtgaccttatgtacgccgacgacaccgcaggatgggacacgcgcatcactgaggacgacctgcagaacgaagagctcatcactgagcagatggcgccccaccacaagatcttagccaaggccatcttcaagctgacctaccagaacaaggtcgtcaaggtgctccggccgaccccgcgcggcgcagtcatggacatcatctcccggaaggaccagcgtgggtccgggcaggtaggcacttacgggctgaacacgttcaccaacatggaggtacagctaatcaggcagatggaggccgagggcgtcatcacacaagacgacatgcagaaccccaaaggtctcaaagagcgcgtggagaagtggttgcgggagtgcggagtggaccgcctgaagaggatggcgatatccggcgacgactgcgtcgtgaagccactagacgagcgcttcgggaccagcctgctgttcttaaacgacatgggcaaggtacggaaagacatcccccagtgggaaccgtccaaggggtggaagaactggcaggaggtccccttctgcagccaccatttccacaagattttcatgaaagacggccgcagtctggtggtcccctgccggaaccaggatgagctgatcgggcgcgccaggatctctcagggggcgggctggtccctcagggagaccgcctgcctggggaaggcctacgcccagatgtggagcctgatgtactttcatagaagggatctccgcttggccagtatggctatctgcagtgccgtcccgaccgagtggtttccgaccagccgtactacatggtccatccacgctcatcaccagtggatgaccaccgaagacatgctgaaggtgtggaaccgcgtgtggatcgaggacaaccccaacatgatcgacaagacccccgtccacagctgggaggacatcccatacctcgggaagcgggaagacttatggtgcgggagtctgatcggtctcagcagtcgcgccacgtgggccaagaacatccacactgccatcacccaggtgcggaacctgatcggcaaggaggagtacgtggactatatgcccgtcatgaagcgctacagtgccccctcggagagcgagggggtgctgtaa

SEQ ID NO: 26242 - RNA, 9867 nt, synthetic construct
  misc_feature 1..9867: note = derived and/or modified CDS sequence (opt11) from DENV-4__GQ199878__SS-prME
  source 1..9867: mol_type = other RNA
agcaccatcactctgctctgcctgatccctacggtgatggcattccacctgtccacccgcgacggcgaacccctcatgatagtggccaagcatgagaggggtcgtcccctgctgttcaagaccaccgagggcatcaacaagtgcacgctgatcgcgatggacctgggggagatgtgcgaggataccgtaacctacaaatgccctctgctcgtaaataccgagcccgaggacatcgactgctggtgcaatctgactagcacctgggtcatgtacggcacctgcacgcagagtggggagcggcgccgagagaagcgatccgtggccctgacgccgcacagcgggatgggcctcgaaacgcgggccgagacctggatgagctccgagggggcctggaagcatgcccagcgcgtggagagttggatcctccggaacccgggcttcgcgctgctcgccgggtttatggcctacatgatcggccagaccgggatacagcgcacggtcttctttgtgctgatgatgctggtggccccctcctacggcatgcggtgtgtaggggtgggcaaccgagatttcgtagagggcgtctcgggcggggcgtgggtggatctcgtgctggagcacggcgggtgtgtcaccacgatggcccaaggcaaacctacattagacttcgagctcacaaagactaccgccaaggaagttgccctgctgcggacttattgcatcgaggcttccatcagcaacataaccaccgccaccaggtgcccgactcagggggagccctacctcaaggaggagcaggaccagcagtacatctgtcggcgcgacgtggtcgaccggggctggggcaacggctgcggcctgtttgggaagggcggggtagtgacgtgcgccaagttctcgtgcagcggcaaaatcacagggaacctggtccagatcgagaacctcgagtataccgtggtagtcaccgtgcataacggggacacgcacgccgtcggcaacgacacctccaaccatggggttactgccaccatcacgccccgcagcccctccgtggaggtcaagttacctgactacggcgagctgaccctcgactgcgagccgagaagcggtatcgatttcaacgaaatgatcctgatgaagatgaagaagaaaacgtggttagtgcacaagcagtggttcctagacctgcccctgccctggaccgccggcgcagacacttccgaggttcactggaactacaaggagcgcatggtcacgttcaaagtgcctcacgccaagcggcaggacgttaccgtcctcgggagccaagagggcgccatgcactctgcgctggccggcgcgaccgaggtggattccggggatggcaatcacatgttcgcagggcacctgaagtgcaaggtgcgcatggagaagctccgcatcaagggcatgagctacaccatgtgctcaggcaagtttagcatcgacaaggagatggcggagacacagcacgggaccaccgtcgtcaaggttaagtacgagggcgcaggggcaccctgtaaggtcccaattgagatccgggacgtaaataaggagaaggtggtagggcgcgtaatctcaagcacccccctggcggagaacacgaactccgtgaccaacatcgagcttgagccgcctttcggtgacagctacatcgtcatcggcgtgggcaactccgctttgacgctgcattggttccggaaaggatcgtccatcggcaagatgttcgagtccacttaccgcggcgccaagcggatggccatcctgggcgagacagcctgggacttcgggtctgtgggcggcctcttcacgagcctggggaaggccgtccaccaagtgtttggctccgtgtataccaccatgttcggaggcgtttcgtggatgatccgcatcctgatcggctttctcgtgctgtggatcggcacgaactcccggaacacaagcatggccatgacctgcatcgctgtcggcgggatcaccctgttcctgggcttcacggtccaggccgatatggggtgcgtggtgagctggagcggccgcgaacttaagtgcgggagcggcatctttgtcgtggacaacgtgcacacgtggaccgagcagtacaagttccagcccgagagtcccgcgcggctggccagcgccatcctgaatgcccacaaggacggcgtctgcgggattcgctccaccacacggctcgaaaacgtgatgtggaagcaaatcaccaacgagctgaactatgtgctgtgggagggcggccacgacctcaccgtggtggccggcgacgtgaagggcgtcctgaccaagggaaagagagccctaacgccgcccgtcagcgacttaaagtactcctggaaaacatggggcaaggccaagatcttcacgccggaggctcggaacagtaccttcctgatcgacgggcccgacacatccgagtgcccgaacgagcgccgggcatggaatagcctggaggtggaggactacggcttcgggatgttcaccacaaacatctggatgaagttccgcgagggctccagcgaggtctgcgaccatcgactcatgagtgccgcaatcaaggaccaaaaagccgtgcacgccgacatgggctactggatagaaagctccaagaaccagacctggcagatagagaaggccagcctgatagaggtgaagacgtgcctgtggcccaagactcacaccctctggtccaacggggtcttggagagccagatgctgattcccaagtcctacgcgggcccgttcagtcagcacaattaccgccaggggtatgccacccagaccgtaggcccctggcacctagggaagctcgaaatcgacttcggcgagtgccccggtacgacagtcaccatccaggaggactgcgaccatagggggcccagcctgcgcaccacgaccgcctccggaaagctagtcacccagtggtgctgccgcagctgcaccatgccgcccttgcgtttcctgggagaggacggctgttggtacggaatggagatccgccccctttccgagaaggaggaaaacatggtgaagagccaggttgccgctggacaaggcacgtccgagactttcagcatggggcttctgtgcctcaccctgttcgtggaggagtgcctacggcggcgggtaacccgcaagcacatgatcctcgcggtcgtgatcacgctgtgcgccatcatcttaggagggttgacctggatggacttactgcgggccctcatcatgctgggcgacaccatgtccggccgcatcgggggtcagacccatctcgccatcatggccgtgttcaaaatgagcccaggttacgtcctcggcgtgttcctgcggaagttaacctcccgcgagaccgcgctcatggtgatcgggatggccatgactaccacgctgtctatcccgcacgacttgatggagctcatagacggcatcagtctgggcctaatcttactcaagatcgtaacccagttcgataacacgcaggtggggaccctggccctcagcctgactttcatacggtccaccatgagcctggtgatggcctggcgcacgatcatggccgtgctcttcgtagtgacccttatccccttatgccggacaagctgtctccagaagcagtcccactgggtcgagatcacagcgctgatcctaggtgcccaggccctccccgtgtacctgatgaccctgatgaagggcgcctcccgccggagctggcccctcaacgagggcataatggcggtgggtctggtttccctgctcgggagtgccctgctgaagaatgacgtgccgctcgccggtcccatggtagccgggggcttgctgctcgccgcgtacgtaatgagcggtagtagcgctgatctgtccctggagaaggccgccaacgtccagtgggacgagatggccgacataaccggctcgtctcccatcattgaggtgaagcaggacgaggacgggagcttctccatccgcgacgtcgaggagacgaacatgatcaccctcctggtaaagctggcgctcataaccgttagcggactgtaccccctggccatcccagtcaccatgacgctctggtacatgtggcaggtaaagacgcagcggtccggcgccctgtgggacgtccccagccccgccgctacccagaaagcggcactgtccgagggggtctatagaatcatgcagcggggactcttcggtaagactcaggtgggcgttgggatccatatggagggcgtcttccacaccatgtggcacgtgacccgtggaagcgtcatctgccacgagacggggcggcttgagccctcctgggcagacgtccgcaacgacatgatcagctacggcgggggctggcgccttggagacaagtgggacaaggaggaggatgtacaggtgctcgccatcgagcccgggaagaaccccaagcacgtccagaccaagcccggcctgttcaagaccttgaccggggagatcggcgccgttacccttgactttaagcccgggacctcaggaagcccgatcatcaaccggaaaggcaaggtgatcgggctgtacggcaacggcgtcgtgaccaagagtggcgattacgtgagcgccatcactcaggccgaacgcataggggagcccgactacgaggtagacgaggacatcttccggaagaaacgcctgaccatcatggacctccacccgggcgccggcaaaaccaaaaggattctgccctccattgtgcgcgaggccctgaagcgacgccttcggaccctcatactggcgcccacgcgcgtcgtcgccgccgagatggaggaggccctgcgggggctccccatccgatatcagacccccgcagtgaagagcgagcataccggccgtgagatcgtggatctgatgtgccatgcgacattcactacccgcctgctcagctccacccgggtccccaactacaacctgatcgtgatggacgaggcccatttcaccgatcccagctccgtcgccgcgcgcgggtacatcagcactcgggtggaaatgggcgaggctgcggccatatttatgaccgccaccccccccggggccaccgatccgtttccccagtccaacagccctatcgaggacatcgagcgtgagatccccgagcggtcctggaacacgggattcgactggatcaccgactaccagggcaaaaccgtctggttcgtccccagcatcaaggccggtaatgacatcgcgaactgcctgcgcaagtccggcaagaaggtgatccagctcagccgcaaaaccttcgacacggaataccccaaaaccaagctgaccgattgggactttgtggtgaccaccgacatctccgagatgggggccaacttccgggcgggccgagtgatcgacccccggaggtgcctaaagcccgtgatcctcaccgacgggccggagcgggtcatcctggccggccctatccccgtcacccctgcgagcgcggcccagcgccggggccgtatcgggcggaatccggcccaggaggacgaccagtacgtgttttccggcgaccccttgaagaacgacgaggaccatgcacactggaccgaagcgaagatgctactggacaatatctacacgcccgaggggatcatccccacccttttcggcccggaaagggagaagacccaagcgattgacggcgaattccggctccgcggggaacagcgaaagaccttcgtcgagctgatgcgccggggcgacctgccggtttggctctcatacaaggtggcctccgccgggatcagctacaaggatagagagtggtgcttcacgggcgagcgcaacaaccagatactcgaggagaacatggaggtcgagatctggacccgcgagggcgaaaaaaagaagctgcggccccgctggctcgacgcccgggtatacgcggaccccatggcgctgaaggacttcaaagagtttgcctcgggacgcaaaagcattacccttgacatcctcacagagatcgcctccctgcctacttaccttagcagccgcgccaagcttgccctggacaacatcgtgatgctgcataccacagagcggggcgggcgggcgtaccagcatgccctcaacgagctgcccgagtccctggagaccctcatgcttgttgccctgctcggcgcgatgactgccgggatcttcctgttcttcatgcaaggcaagggaatcggtaagttgagcatgggcctcatcaccatcgccgtggcctccgggctgctgtgggtggccgagattcagccccagtggatcgcggccagcattatcctcgagtttttcctgatggtcttactcatcccggaacccgagaagcagcggacgccccaggacaaccagctgatctatgtgatcctgaccatcctcaccatcatcggcctgatcgccgccaacgagatgggcttgatcgagaagactaagaccgacttcggcttctaccaggtgaagacggagaccacgatcctcgacgtcgacttaagacccgcgtccgcgtggacactgtacgccgtggccacgacaatcctcacgccgatgctgcggcatactatagagaataccagcgcgaatctgtccctcgccgcgatcgcgaatcaggccgccgtgttaatggggctgggcaagggctggcccctccaccgcatggatctgggggtccccctgctagccatgggctgttacagccaagtgaaccccaccacgctgaccgcgtccttggtgatgctactcgtgcactacgccatcattggcccggggctgcaggccaaggccacccgggaggcgcagaagcgcaccgccgccggcatcatgaagaacccaacggtggacgggatcacagtgatcgacttagagcccatcagctacgaccccaagttcgagaagcagctggggcaggtcatgttactcgtcctgtgcgccggccagttattgctgatgcggaccacctgggccttctgcgaggtgctgacgttggcgaccggcccgatcctgacgctttgggagggaaaccccggccgcttttggaacaccacgatcgcagtctccaccgctaacatattccggggcagctacctagccggggccggcctggcgttctccctgatcaagaacgctcagacccctcgtaggggaaccggcacgaccggagagaccctcggcgagaagtggaagcgccagttaaacagcctggaccgcaaggagttcgaggagtataagcgatccggcatacttgaagtggaccgcaccgaagcgaagagcgccctgaaggacgggtccaagatcaaacacgcggtgtcacgtggctccagcaagatccggtggatcgtcgagcgcgggatggtgaagccaaagggcaaggtggtcgacctcgggtgcggtaggggcgggtggagctactacatggcgacactcaagaatgtgacggaggtgaagggctacaccaaggggggcccagggcatgaggagcccatccccatggccacttacggctggaacctcgtcaagctgcactcaggtgtggacgtgttctacaagcccaccgagcaggtcgacacgctcttatgcgacatcggagagagctcaagcaacccgaccatcgaagagggccggaccctgcgggtactcaagatggtggagccctggctgtcctcgaagcccgagttctgcatcaaggtcctgaacccctacatgccgaccgtgatcgaggagctggaaaagttgcaaaggaagcatgggggcaacctggtccgctgtcccttatcccggaacagcacgcacgagatgtactgggtgtccggcgcctccgggaacatcgtatcttcagtcaacactacctccaaaatgctactgaatcgcttcacgacgcggcatcggaagccgacctacgagaaggacgtggacctgggcgccgggacccggagcgtcagcaccgaaacggagaaacccgacatgaccatcataggcagacggttgcagaggctgcaggaggagcacaaggagacatggcactacgaccaagagaacccctaccgcacctgggcgtaccacgggagctacgaggccccctccacgggcagcgcctccagcatggtcaacggcgtcgtgaagctgctcaccaagccatgggacgtcataccgatggtgacccagctggcaatgaccgatacgacgccatttgggcagcagcgcgtgttcaaagagaaggtcgacaccagaactccccagcccaagccgggcacgcggatggtgatgaccacaaccgccaactggctatgggcgttgctgggtaagaagaaaaaccccaggttatgcacgcgcgaagagttcatctcgaaggtgcggtccaatgccgctatcggcgccgtcttccaggaggagcaggggtggacctctgcctccgaggcggtaaacgacagccgcttctgggagctggtggataaggagcgggccctgcaccaagaaggcaagtgcgagtcctgcgtctacaacatgatggggaagcgcgagaaaaagctgggcgagttcggccgcgccaagggttcacgggccatctggtatatgtggctgggcgcccgcttcctggagttcgaggcgctggggttcctcaacgaagaccactggttcggtcgggagaattcctggagcggagtggagggcgaaggcctgcaccgccttggatacatcctcgaggagatcgacaagaaggacggcgacctgatgtacgcagacgacaccgccggctgggacacgcggatcacggaggacgacctgcagaacgaggagctcatcaccgagcagatggctccccaccacaagatcctggcgaaggccatcttcaagttaacctaccagaacaaggtggtcaaagttctccgccccacgccgcggggtgccgtgatggacataatctcccgcaaggaccagcgcggcagtgggcaggtcgggacttacgggctgaacacgttcaccaacatggaggtgcaacttatccgccagatggaggccgagggcgtgatcacccaggacgacatgcagaaccccaagggcctcaaagaacgggtcgagaagtggttacgcgaatgcggggtggatcggctgaagcggatggccatctccggcgacgactgcgtggtaaagcccctcgacgaacggttcggaacatcgttgctgttcctcaacgatatgggaaaggtgcgcaaggacatcccgcagtgggagccgtccaaagggtggaagaattggcaggaagtgccattttgctcccaccatttccacaagattttcatgaaagacggccggtccctggtggtgccctgtcgcaaccaggacgaactgatcggccgggcgcgcatcagccagggggccggctggtccctccgcgagaccgcatgtctggggaaagcctatgcccagatgtggagcctgatgtactttcaccggagggacctccggctggcgagcatggcaatctgttccgccgtgcccaccgagtggtttcccaccagtcgcaccacgtggtccatccacgcccaccatcagtggatgaccaccgaggacatgctgaaagtctggaaccgggtctggatcgaggacaaccctaacatgatcgataagacccccgtgcactcttgggaggatatcccctacctcggcaagcgagaggatctgtggtgtggaagtctgatcggcctcagctcccgggcgacgtgggcaaagaacatccacaccgccatcacccaggtccgcaacctgatcggcaaggaggagtacgtggattacatgccggtgatgaaacggtacagcgccccctccgagagcgaaggggtcctgtga

SEQ ID NO: 26243 - RNA, 9867 nt, synthetic construct
  misc_feature 1..9867: note = derived and/or modified CDS sequence (opt11) from DENV-4__GQ199879__SS-prME
  source 1..9867: mol_type = other RNA
tcaaccatcactctgctctgcctgatccccaccgtcatggcattccacctatcgacgcgggacggtgaaccgcttatgatcgtggccaagcacgaacgggggcgtcccttactttttaagacgaccgaaggcataaacaagtgcaccctcatcgcgatggacctgggcgagatgtgtgaggacaccgtgacctacaagtgcccattgttggtaaacactgagcccgaagacatcgattgttggtgcaacttaacgtcgacttgggtgatgtacggaacctgcactcagtccggtgaacggcgacgggagaagcgcagcgttgccctgacgccccattcaggtatgggcttagaaaccagagcagagacctggatgagctccgagggggcgtggaagcacgctcagagggtggaaagctggatcttgcggaacccgggcttcgccctgctcgccgggttcatggcatacatgattggccagacagggatccagcgaacggtcttctttgtcctaatgatgctggtggcccccagctacggcatgcgatgcgtcggggtggggaaccgcgatttcgttgagggcgtcagtggcggggcgtgggtggacttggtactggagcacggagggtgcgtcaccaccatggcccagggcaagcctaccctggactttgaactaacgaagaccaccgccaaggaggtggccctgttgcggacctactgcatcgaggcctccatctcgaacatcacgacggcgacccgctgccccacacagggggagccctacctcaaggaggagcaggaccaacagtatatctgccggcgcgacgttgtcgaccggggctgggggaatggctgcggtctcttcgggaagggcggcgttgtgacctgcgcaaagttctcctgcagcggcaaaatcaccggcaacctggtacagatcgagaacctcgagtacacggtagtcgtcaccgtccacaacggcgacacgcacgccgttggcaacgacacctctaatcacggggtgacggcaaccatcacgcccagaagcccctcggttgaggtgaagctgccggactacggggagcttaccctcgattgcgagccccgaagcggtattgacttcaacgagatgatcctgatgaagatgaagaagaagacatggctggtccacaagcaatggttcctcgacctgcccctgccttggacagccggggcagacacctccgaggtgcactggaactataaagagcgcatggttactttcaaggtgccgcacgccaagcgccaggacgtgaccgtattagggtcgcaggagggcgcaatgcactcagccctggccggtgcgaccgaggtggactccggcgacggcaaccacatgttcgccgggcacctgaagtgcaaggtacgaatggagaagctccgcatcaaaggcatgagttacaccatgtgctccggcaagttcagcatcgacaaggagatggcagagacgcagcacgggacaacggtcgtaaaggtgaagtacgagggcgccggggccccttgcaaagttcctatcgagatacgggacgtgaacaaggagaaggtcgtgggccgtgtgatttccagcacaccccttgcggaaaataccaactccgtgaccaacatagagctcgaacctccatttggagactcctacatcgtcataggcgtgggtaattctgcccttaccctgcactggttccggaaggggtcctccatcggcaagatgttcgagagcacctatcgaggagccaagagaatggccatcttaggtgaaacggcctgggattttgggagtgtcggaggactcttcacctcactggggaaggccgtccaccaggtgttcggctccgtttacacaacgatgttcggaggcgtcagttggatggttcgcatcctgatcgggtttttggtactgtggatcggcacgaactctcgaaataccagcatggccatgacctgcatcgcagtaggcgggatcaccctgttcctgggattcaccgtccaggctgacatgggttgcgttgtctcatggtcgggccgcgagctcaaatgtggaagcgggatcttcgtggtggacaacgtccacacctggacagagcagtacaagttccagccagagtccccagcccggctggccagcgcaatactgaatgcccacaaggatggcgtgtgcggcatccgctcgaccacccgtctagaaaatgtgatgtggaagcagatcactaacgaactgaactatgtcctgtgggagggaggtcacgacctcaccgttgtggcgggggacgtcaagggcgtacttactaaggggaagcgcgcgctgaccccgccggtgagcgacctgaagtactcctggaaaacctggggcaaggccaagatcttcacccccgaagcccgcaacagcaccttcctcatagatggacctgacacatccgagtgtccgaacgaacgccgagcctggaactcgctggaggtcgaagactacggcttcgggatgttcaccacaaacatctggatgaagttcagggaaggatcctcagaagtgtgcgatcatagactcatgtccgccgcgatcaaggatcagaaagccgtgcacgcggacatgggctactggatcgaatcctcaaagaaccagacgtggcaaatcgagaaggcgagcctgatcgaggtgaagacatgcctgtggcccaagacccacaccctctggtctaacggggtcctcgagagccaaatgttaatccccaaatcctatgcaggtcccttcagccagcacaactaccgccagggttacgccacgcagaccgtgggcccctggcatcttgggaagctggagatcgacttcggcgagtgccccggcaccacggtcaccatccaagaggactgcgaccaccgggggcctagcctgcggaccacgactgcctccgggaagctcgtgactcaatggtgctgccgcagttgcacgatgccacccctacggtttctcggggaggatggctgctggtacggtatggagatccgacccctcaatgagaaggaggagaacatggtcaagagccaggtgacggccggacagggcactagcgagaccttctccatggggctgctgtgcctcaccctgttcgtagaggaatgcctgcgacgccgtgtgacgcgcaagcatatgatcctcgtggtggtcatcaccctgtgcgccattatcctgggcggcctcacgtggatggacctactgcgggcgttgatcatgctgggcgacaccatgtccggtcgcatcgggggccagatacacctggccatcatggcagtgttcaagatgagtcccgggtacgtcctaggcgtcttcctgcggaagctgacgagtcgcgagactgccctcatggtgatcgggatggcaatgactacagtgctgagcattccgcatgacctaatggagctcatcgacggtatcagcctgggccttatcctcttgaaaatcgttacgcagtttgacaacacccaggtggggaccctggccttgtccctgaccttcatccggagcacgatgcccctggtgatggcctggcgcaccatcatggccgtcctcttcgtggtgactctgatccccctgtgccgaacctcatgcctccaaaagcaaagccattgggtcgagattacggccctgatcctgggcgcccaggctttgcccgtgtacctaatgaccctgatgaagggagcctcccgcagaagttggccgctcaatgaaggcataatggcagtgggcctggtctccctactcggcagcgccctgctaaagaacgacgtgcccctcgcgggtcccatggtggccgggggcctgctgcttgcggcctacgtcatgtccggtagctccgccgacctttccctggaaaaggctgccaacgtgcagtgggacgagatggccgatataaccggctcatcccccataatcgaggtgaagcaggacgaggacgggagcttctccatcagagacgtagaagagaccaatatgatcacacttcttgtgaagttggcgctcataaccgtgagcggcctgtacccgctggccatccccgtcaccatgaccctctggtatatgtggcaagtgaagacacagcgttccggcgccctgtgggacgtgcccagccccgccgccacccagaaggccgccctttccgaaggggtgtaccggatcatgcaacggggtctcttcggaaagacgcaggttggagtggggattcatatggagggcgtcttccacaccatgtggcacgtgacccgtggaagcgtgatctgccacgagacagggcggttagagccttcctgggctgacgtcagaaatgacatgatcagctacggagggggctggcgcctcggtgataagtgggataaggaggaggacgtacaggtgcttgccatcgagccgggcaaaaacccaaaacacgtccagactaagcccggcctttttaagaccctgactggggagatcggagcagtgacccttgatttcaagccggggacctccggcagccccattatcaacaggaagggcaaggtgatcgggctgtacggcaatggtgtcgtaaccaagtcgggggattacgttagcgccatcacccaggccgagcgcatcggcgagcccgactacgaggttgacgaggacatcttccgcaagaagcgcttaacgattatggacctccacccgggcgcgggcaagaccaagcggatcctgccctctatcgtgcgagaagcgttaaagcgccggctgcggaccctaattctggccccgacccgcgtagtcgccgccgagatggaggaggccctccgggggctccccatccgctaccagacgccggccgtgaaaagcgagcacaccggccgggagatcgtcgacctaatgtgtcacgccaccttcactacgagactgctatctagcacacgtgtccccaattacaacctgatcgttatggacgaggcccacttcaccgatccctcgtccgtcgcggcccgcggatacattagcacacgggtggagatgggagaggccgccgccatcttcatgacggcgaccccgcctggggcaaccgaccccttcccccaatcaaacagcccgattgaggatatagagcgggagatcccggagcggtcatggaacaccggattcgattggatcacggattatcaggggaagacagtgtggttcgtcccctctatcaaagccggaaacgacatagccaactgcttacggaagagtggcaagaaggtgatccaactctcgcgtaaaaccttcgacaccgagtaccccaagacgaaactgacggactgggactttgtggtcaccaccgacataagtgaaatgggggctaatttccgggcgggccgagtcatcgacccccgacgttgcttgaaaccagtgatcctcactgatggtccagaacgggtaattctggccggacctattcccgtgacccctgccagcgccgcgcagcgccggggacgcatcgggcggaacccggcacaggaggacgaccagtacgtgttctcgggcgatcccctgaagaatgacgaggaccacgcccattggacagaggccaagatgctcctggacaacatctatacgcccgagggaatcataccgacgctgttcggtccggagcgcgagaaaacgcaggccatcgacggcgagttccggctgcgcggggagcaacgcaaaacgtttgttgagctaatgcgccgtggagaccttcccgtgtggctctcttacaaggtggcctccgccggaatctcgtacaaggacagggagtggtgtttcaccggcgagcggaacaaccagattcttgaggagaacatggaggttgaaatctggactcgcgaaggggagaagaagaagctgcggccgcgctggcttgacgcacgggtatatgccgacccgatggccctgaaggactttaaggaatttgcgtccggcagaaagagcatcaccctggatatcctaaccgaaattgcatccctgcccacctacctgagctcccgtgccaaacttgccctggacaacatagtgatgctgcacaccacggagcgtggagggcgcgcttaccagcacgcgctcaatgagctgcccgaaagcctggagacactcatgctggtcgcactgcttggcgcgatgacagccggcatctttttatttttcatgcagggcaaggggataggcaaactgtctatgggcctcatagccatagccgtggcctccgggctgttatgggtagccgagatccagccccagtggatagcggctagcataatactcgagttcttcctcatggtgctgcttatcccagagcccgagaagcagcggacgccacaggacaaccagctgatctatgtcatcttaacgatcctgaccatcatcggcctgatcgcagccaatgagatggggctgatcgaaaagaccaagaccgacttcggtttctaccaggtgaagacggagaccaccatcctcgacgtcgacctgcgcccggcttctgcgtggaccctatatgcggtcgccacgaccatcctcacccccatgctgcggcacacaatcgagaacacatctgccaatctgtctctcgccgccatcgcgaatcaagccgccgtgcttatggggctgggtaagggctggccgctccaccgcatggacttaggagtgcccctgcttgccatgggctgctattcccaggttaacccgacgactctaaccgccagcctagtgatgctgctggtccactacgctatcatcgggcccggcttgcaggccaaggcgacgcgggaggcccagaagcgcactgccgccgggatcatgaaaaacccaaccgtggatgggatcaccgttatcgacttagagccaatcagttacgaccccaagttcgagaagcagctgggccaggtcatgctgctcgtgttgtgtgccggacagctcctcctgatgaggacaacctgggccttttgcgaggttctgacgctcgccactggccccatcctgacgctgtgggaggggaaccctggtcgcttttggaacaccaccatcgcggtgtctaccgccaacatattccgtggcagctacctcgcaggagccggcctcgccttctccctgataaagaacgcgcagacgccgcgccgggggacgggtacaaccggagaaacgctcggcgagaaatggaaacgccaactgaactcgctagatcggaaggagttcgaggagtacaagagatccgggatcctcgaggtggatcggaccgaggccaagagcgccctgaaggacgggtccaagacgaaacatgcagtgagtcgaggttccagcaaaatacgctggattgttgagagaggtatggtgaagcccaagggcaaggtggtcgacctggggtgcgggcgcggcggttggtcctactacatggccacccttaagaacgtgaccgaggtgaagggctacacgaaagggggtccagggcacgaagaacccatccccatggcaacttatgggtggaatctggtcaagttgcacagcggggtggacgtgttctacaagccgactgagcaagttgacaccctgctgtgcgacatcggggagtcgtccagcaatcccacgatagaggaggggcgtaccttacgcgttctcaagatggtcgagccctggctgtccagcaagcccgagttctgcattaaggtgctgaatccttacatgccgacagtgatcgaggagctggaaaaactccaacggaagcacgggggcaacctggtccgctgtccactgagcagaaacagcacacatgagatgtactgggtgtccggtgccagcgggaacatcgtaagctcggtcaatacgacctcaaagatgctcctgaaccggttcaccaccaggcaccgcaagcctacatacgagaaggacgtggacttgggcgccgggacccggagcgtttccaccgagaccgagaagccggacatgacgatcatcggacgccggctacagcgcctgcaggaggaacacaaggagacctggcactacgatcaggagaacccttacagaacctgggcctaccacgggtcatacgaggctccctcaacaggtagcgcctcctccatggtcaacggcgtggtgaagctgctaacgaagccatgggacgttatccccatggtgacccagctagctatgaccgacaccacgcccttcgggcagcagcgcgtgttcaaggaaaaggtcgacacccggactccccaaccgaaacccggcacccgcatgatcatgaccaccactgcaaactggttgtgggccttgctgggtaagaagaagaacccgcgcctatgcaccagggaggaatttatctcaaaagtgcggagcaacgcggctatcggtgccgtgtttcaggaggagcagggatggacgagcgcgtccgaggccgtcaacgacagccgcttctgggaactcgtggacaaggagcgggcgctgcaccaggaggggaagtgcgaatcatgcgtctataatatgatgggtaagcgcgagaagaagctgggggagtttggccgcgctaaggggagccgcgcgatttggtatatgtggctcggcgcccgcttcctagagttcgaggccctagggttcttgaacgaggatcactggttcggccgggagaactcctggtccggggtggagggtgagggcctgcaccgcctggggtatatcctcgaggagatagacaagaaggacggcgacctaatgtacgcagacgacaccgctggctgggatacgcggatcaccgaagacgacctgcagaacgaggaactcatcactgagcaaatggcaccccaccacaagatccttgccaaggcgatcttcaagctaacttaccagaacaaggtggtcaaggtcctcagacccaccccgagaggggctgtgatggacatcatcagtcggaaggaccagcggggctccggacaggtgggcacctacgggttaaacaccttcacaaacatggaagtacagctaatccgtcagatggaggcagagggcgtgatcacccaggacgacatgcagaacccgaagggcctcaaggaacgcgtggaaaagtggcttcgggagtgtggggtcgatcggctaaagcgcatggccatttccggcgacgattgcgtggtgaagccactcgacgagcggttcggtacgagtctgctattcctaaacgatatgggcaaggtccgcaaggacataccgcagtgggaacccagtaaggggtggaaaaactggcaggaggtacccttttgcagccatcatttccacaagatcttcatgaaggacggccggtccctggtggtcccctgccgcaatcaggacgagctgatcggccgggccaggatttcgcaaggggcgggctggagtcttagggagaccgcatgtctcgggaaggcttacgcccaaatgtggagtcttatgtactttcatagacgtgacctacggttggcatccatggcaatctgcagcgccgtaccgacagagtggttccctaccagccgcaccacttggtccatccatgcccatcaccaatggatgacgaccgaggacatgttgaaggtgtggaaccgggtctggatcgaagacaaccccaacatgaccgacaaaacccccatccacagctgggaggacatcccctacctcgggaagcgcgaagacctgtggtgcgggagtctgatcggcctttcatcccgggccacttgggccaagaacatccacaccgcgatcacacaggtgcgcaacctgatcggcaaggaggagtacgtggactacatgcccgtaatgaaacgatatagcgcgccctccgagtcggagggggtactctag

SEQ ID NO: 26244 - RNA, 9867 nt, synthetic construct
  misc_feature 1..9867: note = derived and/or modified CDS sequence (opt11) from DENV-4__GQ199880__SS-prME
  source 1..9867: mol_type = other RNA
agcaccatcaccttgctctgcttgattcccaccgtaatggcctttcacctgagcacacgggacggcgagcccctcatgatcgtcgccaaacacgagcgggggcgtccattattattcaaaaccactgagggcattaataagtgtaccctcatcgctatggaccttggggagatgtgcgaggacactgtaacatacaagtgccccctgctcgtgaacaccgagccagaggatatcgactgctggtgtaacctgacgtcgacctgggtcatgtacgggacctgcacccagtccggggagcggcggcgggagaagcggagcgtggcccttacgccgcattccgggatgggcctcgaaacccgtgccgagacctggatgagttccgagggggcctggaagcacgctcagcgcgtggaaagctggatcctccggaaccccggcttcgcgctgctcgccgggtttatggcctacatgatcggtcagaccgggattcagcggacggtcttcttcgtgctgatgatgctggtcgccccctcctacggcatgaggtgcgtaggtgtgggcaatcgtgatttcgtcgagggcgttagcgggggtgcctgggttgatctcgtgctggagcacggcggttgcgtaaccaccatggcccaaggcaaacctaccttggattttgagcttaccaaaaccacggccaaggaggtggcccttctgcggacctactgcatcgaagcctccatcagcaacatcactaccgcgaccaggtgcccgacccagggggagccgtatctcaaggaggaacaggaccagcagtacatttgtcggcgcgacgtggtcgaccggggctgggggaatggctgcggccttttcgggaaagggggcgtggtgacatgtgcaaagtttagctgcagcgggaagatcaccgggaacttagtccagatcgaaaacctcgagtataccgtggtggtcaccgtacataacggtgacactcacgctgtaggtaacgacaccagtaaccacggcgtgaccgccaccataacgccccgctcccctagcgtggaggtaaagctgcctgactatggcgagctgacactcgattgcgaaccacgcagcgggattgacttcaacgagatgatcctgatgaagatgaagaagaaaacttggctggtacacaagcagtggttcctcgacctgccgctgccctggacggccggcgcggacacctccgaggtccactggaactacaaagagcgaatggtaacgttcaaggtgccgcacgccaagcggcaggacgttaccgtcctcggtagccaggaaggcgccatgcactcagccctggcaggcgcgaccgaggtggactccggggacggtaaccacatgttcgcggggcaccttaagtgcaaagtccgcatggagaagctccgcataaagggcatgagctacaccatgtgctccgggaagttcagcatcgacaaggagatggctgaaacgcaacatgggaccaccgtcgtgaaagtgaaatacgagggggccggggccccatgcaaagtccccattgagatacgtgacgtgaacaaggaaaaggtggtcggtagggtcatatccagcacccctttggccgagaacacaaactccgtgaccaacatcgagttggagccgccgttcggcgactcctacatcgtcattggcgttggaaactccgccctcaccctgcactggttccggaagggatcctccatcggtaagatgtttgagtctacgtaccgcggggccaagcggatggcgatcctgggagagacggcttgggacttcgggagtgtaggcggcttgttcaccagtctggggaaagccgttcaccaggtgttcggtagtgtttacactaccatgttcgggggagtttcatggatgattcgcatcctgatagggttcttggtgttatggattggaactaactcccggaacaccagtatggccatgacctgcatagccgtgggcgggatcaccctgttcctgggtttcacagtacaggccgacatggggtgcgtggtgtcgtggagcggccgtgagctcaagtgcgggtcaggcatattcgtcgttgacaatgtgcacacctggaccgaacagtacaagttccagcccgaatccccagcccggctggcatcagccatcctgaacgcccacaaggacggcgtttgcgggatccgctctaccacccggttagagaacgtgatgtggaagcaaatcaccaacgaactgaactatgtgttatgggaaggagggcacgacctcaccgtcgtggccggcgatgtgaagggtgtactcactaagggaaagcgcgcgctgacgccacccgttagcgatctcaagtactcctggaagacctggggtaaggctaagatctttacccccgaggcccggaatagcacattcctgatcgatgggcccgacacgagcgagtgtccgaacgaacgccgggcatggaacagtctggaggtggaggattacggcttcgggatgtttaccaccaatatatggatgaagttccgtgaggggtccagcgaggtctgcgatcatcggctaatgtccgccgcgatcaaggatcagaaggccgtgcatgccgacatgggctactggatcgagagttccaagaaccaaacctggcagatcgaaaaggccagtctgatagaagtgaaaacttgtctgtggcccaagacccacaccttatggtccaacggggtgctggaaagccagatgctgatccccaagtcctacgcgggccccttcagtcagcacaactaccgtcaggggtacgccacccagactgtgggcccctggcacctcgggaagctggagatagatttcggcgaatgtcccggcacgaccgtgaccattcaggaggactgtgatcaccggggaccttccctgcgcaccactactgccagcggcaaacttgtcacacagtggtgctgccgaagctgcaccatgccgccccttcggttcctgggggaggacggctgctggtatggtatggagatccgccccctaaacgagaaagaggagaacatggtgaaatctcaggtgacggcgggccagggcaccagcgaaacttttagtatgggcctgctctgcctcactctgtttgtggaagagtgcttgcggcgccgggtgacgcgcaaacacatgatactcgtcgtggttatcaccctatgcgccatcatcctcggagggttgacctggatggaccttctgcgggctcttatcatgttaggcgacaccatgagcggccgcatcgggggccagatacacctggcaataatggccgtcttcaagatgtcacccgggtacgtgctcggagtgttcttacgaaaactgacgagccgggagaccgccctgatggtcatcgggatggccatgaccaccgttctgtctatcccgcacgaccttatggagctcattgacggcatctctctgggcctgatcttgctgaaaatcgtgactcagttcgataatacccaggtcgggacgctagcgctcagtctcactttcatccgaagcacgatgccgctggtcatggcctggcgcaccatcatggccgtccttttcgtggtgaccttgatcccactatgccggacgagctgcctccagaagcagagccactgggtggagataacagccttaatcttgggcgctcaggctctccccgtctacctgatgaccttgatgaagggggcatcccgacggagctggccgctcaacgaggggatcatggccgtggggctggtgagcctgctcggcagcgcactgctcaaaaatgacgtccccctcgcgggccccatggtggccggaggcctgcttctcgcagcctacgtgatgtccgggagcagtgccgacctttcgttggagaaagcggccaatgtccagtgggatgaaatggcggacatcaccggatcatcccccatcatcgaagtgaaacaagacgaagacggtagcttctccatccgcgacgtcgaggaaactaacatgataaccctcctggtcaagctcgccctcattacggtctcgggcctttacccactggccatccctgtgaccatgaccctgtggtacatgtggcaggttaagacgcagcggtccggcgcattgtgggacgtacccagccccgcagccacacagaaggccgcgctttcggagggggtgtatcgaattatgcagcggggcctattcggaaagacccaggtgggagtggggatccacatggagggagtgttccacacgatgtggcacgttactcgcggcagcgtgatatgccacgagactgggcggttagaaccgtcatgggcggacgttcgcaatgacatgatctcctacggcggtggctggcgcctgggcgacaaatgggataaagaggaggatgtccaggtgctcgccatcgagcccgggaagaaccccaagcacgtgcagaccaagcccggcttattcaagacactgaccggggaaatcggcgcggtcacgctcgacttcaagccggggacctccggaagccctataatcaatcggaaaggcaaggtaataggactttacggaaacggcgtggtaaccaaatccggcgactacgtgagcgccatcactcaggccgaacgtattggtgagcccgattacgaggttgacgaggacatcttccggaagaagcggctaacgatcatggacctccaccctggcgcgggtaaaacgaagcggattctacccagcattgtaagagaggctctgaaaaggcgactccgcaccctcatccttgcgcccacccgagtcgtggcggcggagatggaagaagccctccgagggttacccatccgctaccaaacgcccgccgtaaagtctgagcataccggccgcgaaatcgtggacctcatgtgccacgccaccttcaccacgcgattattatcgagcacacgtgtgcctaactacaacctgatcgtcatggacgaggcccacttcaccgaccccagctccgtggcggcccgcggttacataagcacgagagtcgaaatgggcgaagccgccgcaattttcatgactgcgaccccgccaggggccaccgaccccttcccccagtccaactcacccatcgaggacatagagcgtgaaatcccggagcggtcctggaacaccggattcgactggattaccgactaccagggcaagaccgtgtggttcgttcccagcatcaaggccggcaacgacatcgcaaactgcctgagaaagtctggcaagaaagtcatccagctcagcaggaagaccttcgacacggagtacccgaaaacgaagctaaccgactgggattttgtcgtgaccaccgacatcagcgaaatgggggcgaactttcgggcgggacgtgttatagacccccgcagatgcctgaagccggtgattttaacggacggcccggagcgggtgatcctggctggtccaatccctgtcacgccggctagcgcagcgcagagaaggggacgcattgggagaaaccccgctcaggaggacgaccagtacgtgttttctggcgatcccctgaaaaacgacgaagaccacgcccactggaccgaggccaagatgctactggacaacatctacacccccgagggaataatcccgacactgttcggacccgagcgcgagaagacccaggccatcgacggagagttccggctacgaggggaacagcgaaagacattcgtggagttgatgcgccgcggcgacttacccgtctggctgtcttacaaggtggcgtccgccggcataagctacaaagacagagaatggtgcttcacaggcgagcgtaacaaccagattctggaagaaaacatggaggtggagatttggacgcgcgagggggagaaaaagaaactgcggccccgttggcttgacgcaagagtctatgccgacccaatggccctaaaggacttcaaggagttcgcgtccggccggaaaagcattacgcttgacatccttaccgagatagcctcgctccccacctacctgagctcccgcgccaagttggcccttgacaacatcgtgatgctccacaccacggagagaggcgggcgggcctaccaacacgcgttgaatgaactgcccgagagcttggaaacactgatgctggtcgcactgctcggcgcaatgacagccggcatattcttgttcttcatgcagggcaaggggatcggcaagttaagcatgggactcatagcgatcgcggttgcttcagggctgctgtgggttgccgagatccaaccgcagtggatagccgcgtcgatcatcctcgagtttttcctcatggtgctgctcatacccgagccagagaaacagcggaccccacaagacaaccagctgatctacgtcatcctgacaatcctcaccatcattggcctgatagcagcgaacgagatggggctcatcgagaagacaaagacggacttcggcttttaccaggtaaagacggagaccaccatattggacgttgacctacgcccggcttccgcctggaccctttacgcggtcgcaacaacgatccttacacccatgctgcggcatactatagaaaacactagcgccaacctgtcgctcgctgccatcgcgaaccaggccgcggtcttgatggggttgggcaagggttggcccttacaccgcatggacttaggggtccctctgctggccatgggttgctacagccaagttaacccgaccaccctgaccgccagcctagttatgttattggtgcactatgcgatcatcggtccagggctgcaggctaaggccacgcgggaggcccaaaagcgcacagcagccggaatcatgaagaacccgaccgtggatggaatcaccgtgatagacctagaacccatctcttacgacccaaagttcgagaagcaactgggtcaagtgatgctgttagtcctgtgcgcaggacagctgctgctgatgcggacaacctgggccttctgtgaagttttaaccctcgcgacgggccccattctgacgctgtgggaggggaacccgggtcgtttttggaacaccaccatcgcggtgtcgaccgccaatatctttcggggcagctacctcgccggggctggtctggctttttccttgataaagaacgcgcagaccccgcgccgggggaccgggactacgggggagacattaggggagaagtggaagcgccagctgaactctctggaccgaaaggagttcgaggagtacaaaaggtcaggcatcctagaagtcgaccggaccgaagcaaagagcgccctgaaggacggctcgaagaccaagcatgcggtgagccgcggtagttctaagatccggtggatcgtggaaaggggaatggtcaaacccaaaggcaaggtggtggaccttgggtgtggacgcggcgggtggtcttactacatggcaacactaaagaacgtcactgaggtaaagggttacacgaaagggggccccggtcacgaggagcccattcccatggccacatatggatggaacctggtgaagttgcacagcggcgttgatgttttctacaagccaaccgaacaggtggacaccttgctgtgcgacatcggtgaaagctccagcaaccccacgatcgaggaggggcggaccctgcgcgtcctgaagatggtggagccctggctgagcagcaagcccgagttctgcattaaggtccttaacccgtacatgcccaccgttatcgaggaactggagaaactccagcggaagcatggtgggaatctcgtacgctgccccctgtcccggaacagcacccacgagatgtactgggtttccggcgcaagcggaaatattgttagctccgttaatacaacctcgaagatgctactgaaccggttcactacacggcaccgcaagcccacgtacgaaaaggacgtcgacctgggcgccgggacccggagcgttagtaccgagacggagaagccggacatgacgatcattgggcgccggctccagcgcctgcaagaggagcacaaggaaacgtggcactacgatcaggagaacccctaccggacatgggcctaccacggaagctacgaggccccctccacaggcagcgcctcgagcatggttaacggtgtcgtaaagctgttaacgaagccgtgggacgtgatccccatggtcacccagctagccatgacagacaccacgccgttcgggcagcagcgcgtgtttaaggagaaggtagataccagaacccctcagccgaagccaggaacaaggatgatcatgacaacaaccgccaactggctgtgggcccttctgggtaagaagaaaaaccccaggctgtgcacccgagaggagtttatctccaaagttcggtccaacgcggccatcggcgcagtgttccaggaggagcaaggttggacgagtgcttccgaggccgtcaacgacagccggttctgggagcttgttgacaaggagcgggcgctgcaccaggagggaaagtgtgagtcctgcgtttataatatgatggggaaacgcgagaagaagctgggggagttcggcagggccaaggggtcacgcgcgatctggtacatgtggctaggcgcccgattcctggagttcgaagccctggggttcctgaacgaagaccattggttcggcagagagaactcctggagcggcgtggagggagagggcttacacagacttggatatattttagaagaaatcgacaagaaggacggggacctcatgtacgctgatgacacagccggctgggatacccggatcaccgaggacgacctgcagaatgaagaactcatcacggagcaaatggctccccatcacaagatcctcgccaaagccatcttcaagctgacctaccagaacaaggtagtgaaagtccttcgcccgactcccagaggggccgtaatggacatcatctcgcgtaaggaccagcgggggagcgggcaggtaggcacctacggtctgaatactttcacaaacatggaggtccagctgatcaggcaaatggaggccgaaggtgtcatcacccaggatgacatgcagaaccccaaaggcctgaaggaacgagtggagaagtggctcagagagtgcggcgtggatcggctaaagcgcatggccatttctggcgacgactgcgttgtgaagcccttagacgagcgttttgggacctcactgcttttcctcaacgacatgggtaaagtgcgaaaggatatcccgcagtgggagccatccaaggggtggaaaaactggcaagaggtcccattttgcagccatcacttccataaaatcttcatgaaagacggacggtcgctagtggtgccatgccgcaatcaagacgagttgatcggacgggcccgcatcagccagggggccggctggtctcttcgcgagaccgcctgtttggggaaagcatacgcccagatgtggagcctgatgtacttccaccggcgcgacctcagactcgcctccatggccatttgctccgccgtcccgactgagtggttccccacctctagaaccacctggtccatacacgcccatcaccagtggatgacgaccgaggatatgctgaaggtatggaaccgcgtgtggatcgaagacaatccgaacatgaccgacaaaacccctatccactcatgggaagacattccgtacctcgggaagcgtgaggacctgtggtgtgggtccctgatcggcctctcctcacgggcgacgtgggccaagaatattcacaccgcgatcacacaggtccgcaacctcatcggcaaggaagagtacgttgactacatgcctgtgatgaagcgctacagcgcgcctagtgagtcggagggggtgctgtga

SEQ ID NO: 26245 - RNA, 9867 nt, synthetic construct
  misc_feature 1..9867: note = derived and/or modified CDS sequence (opt11) from DENV-4__GQ252675__SS-prME
  source 1..9867: mol_type = other RNA
agcaccatcaccctgctctgcctgatacccaccgtgatggcattccacctatccacccgggacggcgagcccctcatgatagtggccaagcacgagcgcgggagacccctgctgttcaagacgaccgaaggcatcaacaagtgcaccctaatcgccatggatctcggagagatgtgcgaggataccgtgacctacaagtgtcccctgctcgttaatacagagcccgaggatatcgactgctggtgtaacctgacctcgacctgggtaatgtatggtacctgcacccagtccggggagcggcgccgggagaagcgtagcgtggccctgaccccacactccggcatgggccttgagacccgggccgagacctggatgagctctgagggggcctggaaacacgcccagcgcgtggagagctggatcctgcggaacccgggattcgcactgctcgccgggtttatggcctacatgataggccagacggggatccagcgcaccgtgttctttgtgctgatgatgctggtggccccctcatatggtatgcggtgcgtgggcgtagggaaccgcgacttcgttgaaggcgtcagcgggggcgcgtgggttgacctcgtgctggaacacggcgggtgcgtcaccaccatggctcagggcaaacccaccctggatttcgagctcacgaagaccacagccaaggaggtggcactgctgcggacctactgcatcgaggctagcatcagcaatatcacgacagcgacccgctgcccgacccagggggagccatacctgaaggaggagcaggaccaacagtacatctgccggcgcgacgtggtcgaccggggctgggggaacggctgcggcctgttcggtaagggcggcgtggtgacgtgtgccaagttctcctgcagcggcaagataaccgggaacctggtccagatcgagaatctcgaatacaccgtggtggtcaccgtccataacggcgacacccacgccgttgggaacgatacctccaaccatggggtgaccgcgaccatcacgcccagaagtccgtccgtggaggtcaagctcccggactacggcgagctgaccctcgactgcgagccccgcagcgggattgacttcaacgagatgatcctgatgaagatgaagaagaaaacctggttagtgcacaagcagtggtttctcgacctgcccctgccctggaccgccggcgcggacacctccgaggttcactggaattacaaggaaaggatggtcactttcaaggtgccgcacgccaagcggcaagacgtgaccgtcctcgggagccaagagggagccatgcacagcgccctggccggcgcgaccgaggtggactccggcgacggcaaccacatgttcgccgggcacctgaagtgtaagatccgcatggaaaagcttcgcatcaagggcatgagctataccatgtgctctggcaagttcagcatcgacaaggagatggccgaaacgcaacacgggaccacagttgttaaggtcaagtatgagggtgccggggccccctgcaaggtgcccattgaaatccgtgacgtcaataaggagaaggtggtgggacgcgtcatcagcagcactcctctggcggagaacacgaacagcgtgacgaacatcgagctggagccgcccttcggggacagctacatcgtgatcggcgtcggcaattccgccctcaccttacattggttccggaaggggagcagtatagggaagatgttcgagagcacctaccgcggagccaagcggatggccatcctgggcgagacggcctgggatttcgggtccgtgggcggcctattcaccagcctggggaaggcagtgcatcaagtcttcggctccgtgtacactaccatgttcgggggcgtatcttggatgatccgtatcctcataggattcctggttctgtggattggcacgaactcccggaacaccagcatggccatgacctgcattgccgtgggaggcatcaccctgttcctcggcttcacggtgcaggccgatatggggtgcgtagtgtcctggagcgggcgcgaactcaaatgcgggagcggcattttcgttgtcgacaacgtacacacctggacggagcagtacaagttccaacccgagtcccccgcgcgcctggccagcgccatccttaacgcacacaaggacggagtgtgcgggatccgctcgaccacccggctcgagaacgtcatgtggaagcagattaccaacgagctgaactacgtgctgtgggagggcgggcacgatctcaccgtggtcgccggcgacgtgaagggagtgctgaccaaagggaagcgcgcgctgacgccacccgtcagcgacctcaagtactcctggaagacttggggcaaggccaagatcttcacccccgaggcccggaacagcacattcttaatcgacgggcccgacacgtccgagtgcccgaacgagaggcgagcttggaacagcctggaggtggaagactatgggttcgggatgttcaccaccaacatctggatgaagttccgcgaaggctcctcggaggtgtgcgatcaccggctcatgtccgccgcgatcaaggaccaaaaggccgtgcacgccgacatgggctactggatcgagtcatctaagaaccagacctggcagatagagaaagcctctctgatcgaggtgaagacgtgcctgtggcccaaaacccacaccctctggtccaacggggtgctggagagccagatgctgatccccaaatcctacgcgggcccgttcagccagcacaactaccgccaggggtatgccactcaaaccgtcgggccctggcacctcgggaagctcgagatcgatttcggcgaatgtcccggcacgactgtgaccattcaggaggactgcgaccaccgggggcccagcctgcgcaccaccaccgcgtccggcaagctggtgacccagtggtgctgccgcagctgcaccatgccgcctttgcggttcctgggggaggacggctgctggtacggtatggagattcgcccgctcaacgagaaagaggagaatatggtcaagtcccaggtgaccgccggccagggcaccagtgagaccttttccatggggctgctgtgccttaccctgttcgtcgaggagtgcctgcgacgccgggtgacgcgcaagcacatgatgctcgtggtagtgatcaccctgtgcgcgatcattctgggcgggctcacatggatggatctgcttcgtgctctgatcatgctgggtgacacaatgtcaggccgcatcggggggcagatccacctggccataatggccgtgttcaagatgtcacccgggtacgtcctcggcgtgttcctgcggaagctgacgagccgcgaaaccgccctcatggtgatcgggatggccatgaccaccgtcttaagcatcccgcacgaccttatggaactcatcgacggcattagcctaggcctgattctcctgaaaacggtgacccagttcgacaacacccaggtggggaccttggcactctcccttaccttcatccggtccaccatgccccttgtaatggcctggcgaaccatcatggccgtgctcttcgttgtcaccctgatccccctttgccggacttcgtgcctccagaaacagagccactgggtcgagatcacggccctgatactgggtgcccaggcgctccccgtgtaccttatgaccctgatgaagggggcttcccggcggagctggccgctcaacgaaggtatcatggccgtcgggctggtgtccctcctcggaagcgccctgctgaagaacgacgtgcccctcgcgggacccatggtcgcagggggcctgctgctcgccgcctacgtcatgagcggtagcagtgccgacctgtccctggagaaggcggctaacgtgcagtgggacgagatggccgacatcacgggcagctcccccatcatcgaggtcaagcaggatgaggacgggagcttctccatccgcgacgtggaagagacgaacatgatcaccctcctggttaagctggccctcatcaccgtcagcggcttatacccgctggccatacccgtcaccatgacgctctggtacatgtggcaagtcaaaactcagcggtccggcgcgctgtgggacgtcccctcacccgcggcaacccagaaggccgccctgtccgagggggtataccgcatcatgcagcggggcttattcgggaagacccaggtaggagtaggcatccacatggagggtgtgttccacaccatgtggcacgtaacgcgcggcagcgtcatttgccacgaaaccggccggctagagccgtcatgggcggacgtgcgcaacgacatgatctcctacggcgggggctggcgcttaggcgacaagtgggacaaggaggaggacgtgcaggtcctcgccatcgagcccggcaagaaccccaagcacgtgcagacgaagcccggcctgttcaagacgctgacgggtgagatcggcgcagtgacactcgacttcaagccggggacctccggctcccccatcatcaacaaaaagggcaaggtcatcgggctctacgggaacggggtggtgaccaagtctggcgactacgtatccgccatcacgcaggcagagcggataggcgagcccgactacgaggtggatgaagacatctttcgcaagaaacggctgaccatcatggacctgcacccgggcgcgggcaagaccaagcgcatcctgccctcaatcgttcgagaggccctgaagcgcaggctgcgcacgctgatccttgcccccacgcgagtcgtcgccgcggagatggaagaagctctgcgaggcctcccgatccggtaccaaactccggccgtcaaaagcgagcacaccggccgcgagattgtagacctgatgtgccacgccactttcacgacccggctactctccagcacccgcgtgcctaactataacctgatcgtgatggacgaagcccatttcacggaccccagctcggtagcggcccggggttacatctcaacgcgcgtggagatgggcgaggccgccgccatcttcatgaccgcgacgccacctggggccaccgaccccttcccacagagcaatagccccatcgaggacatcgagcgggagatcccggagcgctcctggaacacgggcttcgactggatcaccgactaccagggtaagaccgtctggttcgtgcccagcatcaaggccggtaacgacatagccaactgcctgcggaagtccggcaagaaggtgatccagctcagccgcaaaaccttcgatacggaatatcccaagaccaagctgacagactgggactttgtcgtaaccacggatatctccgagatgggcgccaacttccgcgcgggccgggtgattgacccccgcagatgcctgaagccggttatcttaaccgatgggcccgagcgcgtcatactagccggcccgatccccgtgaccccggcaagcgcggcgcagcggcgcggccgcattgggcgtaaccccgcccaggaggacgaccagtacgtgttcagtggagaccccctaaaaaacgacgaggaccacgcccattggaccgaggccaagatgctcctagacaacatctacacgccggaaggtatcataccgaccctgttcggccccgagcgggagaagacccaggccattgacggcgagttccgcctccgcggggaacaacgcaagaccttcgtggagctgatgcggcgcggcgacctgcccgtgtggcttagctacaaggtggcgtccgccggtatcagctacaaagaccgggagtggtgcttcacgggcgaacgcaacaaccagatattagaggagaacatggaggttgagatttggacacgggagggggagaagaagaagctgcgcccacggtggctcgacgcacgcgtgtatgccgatccgatggccctaaaggactttaaggagttcgcgtccggccgcaagagcatcaccctggacatcctgacggagatcgcctcccttcctacctacctgtcgtcacgcgcgaagctggctctggacaacattgtaatgctgcacacgaccgagcgcggcgggcgggcctaccagcacgctctcaacgagctgccagagagcctagagaccctcatgctggtagccctgctcggcgccatgaccgccgggattttccttttctttatgcagggcaaggggatcggcaagctgagcatgggcctcatcgcgatcgccgtcgcctcggggctgctgtgggtcgccgagatccagccgcaatggatcgcagcgagcatcatactcgagtttttcttaatggtgctgctcatccccgagcccgagaagcagcgcacgccccaggataaccaactgatctacgtgatcttaacgatcttgacgattattggcctgatcgcagccaacgagatggggctcatcgagaagaccaagacggacttcggcttctaccaggtcaagaccgagaccactattctcgatgtggacctgagacctgcctccgcatggacgctgtatgcggtggccaccaccatcctcacacccatgctgcgacacactatcgagaacaccagcgctaacctgtccctcgccgccatcgctaaccaggccgccgtcctgatggggctgggcaaaggctggcccctccatcggatggacctgggggttcccctgctcgcgatggggtgctacagccaagtgaacccgaccaccctgacagcctccctggtcatgctactcgtgcactacgcgatcatagggcccggactgcaggccaaggcaacacgagaggcacagaaacggaccgcggccgggatcatgaagaaccccaccgtggacgggatcacggtcatcgacctcgagccgatcagctacgacccgaagttcgagaagcagctgggacaagtgatgctgctcgtattgtgcgccgggcagctgctcctgatgcgcaccacctgggccttctgcgaggtcctgaccctcgccacagggcctatcctgaccctgtgggaggggaaccccggtcggttctggaacacaacaattgcggtgtccacggccaacattttccgcggcagctacctcgccggggcaggcctggctttctcactaatcaagaacgcgcagacgccccgtcgagggaccgggacgacgggggagacactcggcgagaagtggaaacggcagttaaacagcctggatcgcaaggagtttgaggagtataagcggtccggtatcttagaggtggaccgcaccgaggccaagagcgcgctcaaagacggatccaaaaccaagcacgccgtcagccggggctccagcaaaatccgctggatcgtggagcgggggatggtcaagcccaagggcaaggtcgtggacctgggatgcgggcgtggcgggtggtcctactacatggccactctcaaaaacgtgacggaggtcaagggctacaccaagggcggccccgggcatgaggagcccatccctatggctacctacggctggaacctggtgaagctgcacagcggcgtggatgtcttctacaaaccgacagagcaggtcgacacgctactgtgcgacatcggggagagcagttccaaccccaccatcgaggagggtcgcacactgcgggtgctcaagatggtagagccctggctgtcctcaaagcctgagttctgcatcaaggtgctgaacccatacatgcccaccgtaatcgaggaactggagaagttacagcgcaagcacgggggtaacctggtccggtgccctctgagtcgcaatagcacgcacgagatgtactgggtgtccggcgcgagcggaaacattgtctccagcgtgaacaccacttccaagatgctcctgaaccggtttaccacgcgccaccggaagccaacgtacgagaaggacgtggacctgggcgccgggacccgcagcgtctccacagagacggaaaaaccggacatgacgattataggccgacgcctccagcggctgcaggaggagcataaggagacctggcattacgaccaagaaaacccttaccgcacctgggcctaccacggtagctacgaggcaccctccacgggtagcgcctccagcatggtaaacggcgtagtcaaactgctcaccaagccgtgggacgttatccccatggtgactcagctggcgatgacagacacgacccccttcggacaacagcgggtcttcaaagagaaggtggacacgcgcacgccccagccgaagcccggcactcggatgataatgaccaccaccgccaattggctgtgggcccttctggggaagaagaagaacccacgcctgtgcacgagggaggagttcatctccaaggttcgctcaaacgcggcaatcggcgcggtctttcaagaggagcaaggttggactagcgcctccgaggccgtgaacgacagccggttctgggagctagtggacaaagagcgggcgctgcatcaggagggtaaatgcgagtcctgcgtctacaatatgatgggcaagcgggagaagaagctgggggagtttgggagagccaaggggtctcgcgccatatggtacatgtggcttggcgcgcggttcctggagttcgaggctctggggttcctcaacgaggaccactggttcggccgcgagaactcctggagcggcgtggagggggagggcctgcatcggctggggtatatactcgaggagatagacaagaaggacggcgacctgatgtacgcggatgataccgccggctgggacacgcgcatcacggaggacgacctgcagaacgaagagctcatcaccgagcagatggcgccccatcacaaaattctggccaaggcgatctttaaacttacttaccagaacaaggtggtcaaggtgctccggccgacgccccgcggagctgtgatggacatcatctcccggaaggaccagcgtggcagcgggcaggtcgggacctacgggctgaacacgttcaccaacatggaggtgcagctgattcgtcagatggaggccgagggcgtaatcacccaggacgacatgcagaaccccaagggcctcaaagagcgggtggagaagtggctgcgggagtgtggggtggaccgccttaagcggatggccatctcaggcgatgactgcgtggtgaaacctttagacgaacgcttcgggactagcctgctattcctcaacgacatgggcaaggtgcggaaggacataccgcaatgggagccctccaagggttggaagaactggcaggaggtccccttctgcagccaccacttccacaagatcttcatgaaggatggccgttccttggtcgtgccatgccggaaccaggacgagctgatcggccgggcccggatcagccagggggcgggctggtccctccgcgagacggcctgcctgggtaaagcctacgcccagatgtggagcctgatgtacttccaccgccgggacctccgcctggcctcgatggcaatctgcagcgccgtcccgacagaatggttccctacgtcccggaccacgtggtctatccacgcccaccaccagtggatgaccactgaggatatgctaaaggtatggaatcgcgtttggatcgaggacaacccaaacatgaccgacaagacgcccatacacagctgggaggatatcccgtacctcggcaagcgggaggacctgtggtgcgggtccctgatcggcctcagctcccgcgccacctgggccaagaacattcacacagcgatcacccaggtgcgtaacctgatcggtaaggaggagtacgtagactacatgcccgtgatgaagcgctacagcgccccctccgagagcgagggggtgctctga

SEQ ID NO: 26246 - RNA, 9867 nt, synthetic construct
  misc_feature 1..9867: note = derived and/or modified CDS sequence (opt11) from DENV-4__FJ810417__SS-prME
  source 1..9867: mol_type = other RNA
tctaccataaccctgctatgcctgatccccacggtgatggccttccacctgtccacccgtgacggcgagccactcatgatcgtcgccaagcacgagcgggggcgccccctgctattcaagactactgagggcatcaacaagtgcacgctcatagcgatggatctgggggaaatgtgcgaggacacagttacctacaagtgccccctgctcgttaacaccgagccagaagacatcgactgctggtgcaacttgacgtctacctgggtcatgtatggcacctgcacccagtccggtgagcggcgccgggagaagcgctccgtagcgctgacgccacactccgggatgggcctcgaaactcgggccgagacctggatgagttccgagggggcctggaagcacgcccagcgcgtggagagctggatcctgaggaaccccggcttcgctctgctcgcgggtttcatggcctacatgatcgggcagaccgggatccagcgcacggtcttcttcgtgctgatgatgctggtggcccccagttatgggatgcgctgcgtcggcgtggggaatagagacttcgtggagggcgtgagcgggggcgcgtgggttgatctcgtgctggagcacggcgggtgcgtcaccaccatggcccaggggaagccaacactggatttcgagctcacgaagacaacggccaaggaggtggccctgctgcggacctactgcattgaggcctctatctcgaacatcaccacagcgaccagatgcccgacccaaggggaaccctacctcaaggaggaacaggaccagcaatacatctgtcggcgcgacgtagtggacaggggctgggggaacggctgcggactgttcgggaagggcggggtggtgacgtgcgccaagttctcctgcagcggcaagatcaccggtaatctagtgcagatcgagaacctcgaatacaccgtagtggtcaccgtacacaacggcgacacgcacgctgtaggcaatgacacttccaaccacggggtaactgccaccatcactccccgctccccctccgttgaggttaagctgccggactacggcgagctgaccctcgactgtgagccccggagcggaatcgacttcaacgagatgatcctgatgaagatgaagaagaagacatggttggtgcataagcagtggttcctcgacttacccttaccctggaccgccggcgcagacaccagtgaggtgcactggaactataaggagcgcatggtaacgttcaaggtgccgcacgcgaaacggcaagacgtgaccgtcctcgggagccaggagggcgccatgcacagcgccctggccggcgcgaccgaggtggactccggggacggcaaccacatgttcgccgggcacctgaagtgcaaggtacgcatggagaagctccgcatcaagggcatgagctatactatgtgttccggtaagttctcgatcgacaaggagatggccgagactcagcatgggaccacagttgtgaaggtgaagtacgagggcgcaggggctccctgcaaggtccccatcgagatccgggacgtgaacaaggagaaggtggtcggccgcgtgattagttctatccccctggcggagaacaccaattccgtgacgaacatcgaattggagccccccttcggggatagctatatcgtcatcggcgtgggcaactctgcacttacccttcactggttccggaaggggagctccatcggcaagatgtttgagagcacctaccgcggggccaagcggatggccatcctgggtgagaccgcgtgggacttcgggtccgtgggcggcttgttcacgagcctggggaaggccgtccatcaagtttttggctccgtgtacacgaccatgttcggcggcgtctcctggatgatccgcatcctgatcgggttcctcgtgctgtggatcggaaccaactcccggaacacgtcaatggccatgacatgtatcgccgtgggcgggatcaccttattcctgggcttcaccgtgcaagccgacatggggtgcgtggtgtcctggagcggccgcgagctcaagtgcggaagcggcatcttcgtcgtagacaacgtgcacacttggacggagcagtacaagttccagcccgagtcccccgcgcggctggctagtgctatcctgaacgcccacaaggacggcgtctgcgggatccgctccacgacccggctcgaaaacgtaatgtggaagcagatcacgaacgagctgaattacgtgctgtgggagggcgggcacgacctaaccgtcgtcgccggcgacgtgaagggcgtcctgaccaaagggaagcgcgccttgaccccgcccgtgtctgacctcaagtactcctggaagacgtggggcaaggccaagatctttacccccgaggcccgcaacagcacctttctaatcgacggtcccgacacctccgagtgcccgaacgagaggcgggcctggaacagcctggaggtcgaggactacggctttggaatgttcacgaccaacatctggatgaaattcagggagggttccagcgaggtctgcgaccatcggctcatgtccgccgcgatcaaggaccagaaggcggtgcacgcggacatgggttactggatcgagtcgtccaagaaccagacctggcagatcgaaaaagccagcctgatagaggttaagacctgcctgtggcccaagacgcacaccctctggtccaacggggtgcttgagtctcagatgctgatacccaagtcctacgcaggacctttcagccagcacaactacagacaagggtacgccacgcagaccgtgggcccgtggcacctcgggaagctggagatcgacttcggcgagtgccccggaaccacggtaaccatccaggaggactgcgatcaccgggggcccagcttacgcaccaccacggcctccggcaagctcgtgacacagtggtgctgccgcagctgcaccatgccgcccctgcgcttcctcggcgaggacggctgctggtacgggatggagatccgccccctcaacgagaaggaggagaatatggtgaagtcccaggtcaccgccggtcagggaaccagcgagaccttctcaatggggctcctgtgcctcaccctgttcgtggaagagtgcctccgcaggagagtgacccggaagcacatgatcttagtagtcgtgatcactctgtgcgccatcatcctaggcgggctcacctggatggacctgctacgcgcgctcatcatgctgggcgacaccatgagcggccgcatcggcggccaaatccacctggccattatggcggtctttaaaatgtcccccgggtacgtcctcggagtgttcctgcggaaactaaccagccgcgaaactgcccttatggtcatcggaatggccatgaccaccgtactgtccataccgcacgacctgatggagctcatcgacggcatcagcctgggcctcatccttctgaagatcgtgacccagttcgacaacacgcaggtcggcaccctggcgctcagcctgaccttcatccggagtaccatgcccctggttatggcatggcgcacgatcatggccgtgctcttcgtcgtgacattaatccccctgtgccgaacatcctgtttacagaagcaatcccactgggttgaaatcaccgccctcatcctgggcgcccaggcgttgcccgtctacctgatgacgttaatgaagggggcctcccgtcggtcatggccgctcaacgagggaatcatggccgtagggttagtgtccctgttaggcagcgccctgctgaaaaacgacgtcccgctcgcgggccccatggtggccggcggactgctgctcgccgcctacgtgatgtccggcagctccgccgatctgtccctggagaaggcggccaacgtccagtgggacgagatggccgatatcaccggctcctcccccatcatagaggtcaagcaggatgaggacgggtccttctccattcgcgacgttgaggagaccaacatgatcaccttattggtcaagctggccctcatcacggtgagcggcctgtacccgctggccatccccgtcaccatgaccctgtggtacatgtggcaggtcaagacccagcggtccggcgcgctgtgggacgtgcccagccccgccgccacgcagaaggccgccctgtccgagggggtgtaccgcatcatgcagcgaggcttgttcgggaagacccaggtcggcgtgggtattcacatggagggcgtgttccacaccatgtggcacgtaactcgcggcagcgtgatctgccacgagaccgggcggctggagccgtcctgggcggacgtgcgcaacgacatgattagctacggcgggggctggcgcctgggcgacaaatgggacaaagaggaggacgtccaggtactcgccatagagcccgggaagaaccccaagcacgtacagacgaagcccggcctgttcaagaccttaacaggagagatcggggccgtcacgctcgatttcaaaccggggacgtccggctcccccataatcaaccggaagggcaaggtgatcgggctatatggcaacggcgtggttaccaaatccggggactacgtgagcgccatcacccaggcggagcgcattggggaacctgactacgaggtggacgaggacattttccggaagaagcgcctgacgatcatggacttgcatccgggcgccggcaagacgaaacggatcctgccctcgatcgtccgcgaagccctgaagcggcggctacgcacgctcatcctggcccccacccgcgttgtggccgcggagatggaggaggccctccgggggctccccatccgttaccagaccccggccgtcaaaagcgagcacactggccgagagattgtggacctgatgtgccatgccacatttaccacccgcctcctttccagcacgagagtccccaactacaatttgatcgtcatggatgaggcccacttcaccgaccccagctccgtggccgcacgcggctatatctccacgagagtcgagatgggcgaggccgccgccatatttatgaccgcgacgcccccgggagccaccgaccccttcccccagtccaacagccccatcgaggacatcgaaagagaaatcccggagcggtcctggaataccggcttcgactggattaccgattaccaaggcaaaactgtgtggttcgtgcccagcatcaaggccggcaacgacatcgccaactgcctgcgcaagtccgggaaaaaggtcatccagctcagtcgcaagacctttgataccgagtaccccaagacgaaactgacggactgggacttcgtggtgaccactgacatctccgagatgggggccaactttcgagcgggccgcgtcatcgatccccggcgctgcctgaagccggtgatactcacggacgggcccgagagggtgatcctggccggccccatccccgtcacgccagccagcgccgcgcagcgcaggggccgcatagggcggaaccccgcccaggaggacgaccagtacgtgttctccggtgacccccttaagaacgacgaggatcacgcccactggaccgaggccaagatgctcttagacaacatctacacccccgaggggatcatccctaccctgtttggccccgagcgcgagaaaactcaggccatcgatggcgagttccggctcaggggggagcagaggaagaccttcgtggagctaatgcgccggggcgacctgcccgtctggctaagctacaaggtggcgtcggccggtatctcttacaaggaccgcgaatggtgcttcacaggagagcggaacaaccagatcctggaggaaaacatggaggtcgagatctggacccgggagggggaaaagaagaagctccggccccgctggcttgacgcccgtgtgtacgctgacccgatggccttgaaggactttaaggagttcgcttccggccgtaagagcattacgctggacattttaaccgagatcgcatccctccccacctacctgagcagccgcgccaaactcgctctggacaacattgtaatgctacacacgaccgaacggggggggcgcgcctaccagcacgcgctcaacgaactgcccgagagcctggagactctcatgctggtggcgctgctcggcgccatgaccgcagggatcttcctgtttttcatgcagggcaaggggatcggcaaattaagcatgggcctcatcgcgatcgcggtcgcatccggccttctatgggtggccgagatccagccgcagtggatcgccgcgagcattatcttagagttcttcctgatggtgctgctcatccccgagcccgagaagcagcggaccccccaagacaaccagctgatctacgtgatcctgaccatcctgacgatcatcggcctgatcgccgccaacgaaatgggcctgatcgagaagaccaagaccgacttcggcttttaccaagtgaagaccgagacgaccatcctcgatgtggacttacgcccggcctccgcctggacgctgtacgcggtcgccaccacgatacttacccccatgctgcggcacaccatagaaaacaccagtgcgaacttgtcactagccgccatcgcgaaccaggctgcggtgttaatggggctgggcaagggctggcccctccaccgcatggacctcggggtgcccctgctcgccatgggctgctacagccaggtcaaccccacgaccctgactgcctccctggtgatgctccttgtgcactacgcgatcatagggcccggcctccaggccaaggcgacacgggaagcccagaagcggacggcggccgggatcatgaagaaccccaccgtcgacggaatcaccgtgatcgacctcgagcccatcagctacgatccgaagttcgagaagcagctgggacaggtgatgctgctcgtgctgtgcgccggtcagcttctcctgatgaggacgacatgggccttttgtgaggttctgacattggccacaggcccgatcctgaccctgtgggaggggaaccccggcagattctggaacacgaccatcgcggtgtcaaccgccaacatcttcagaggcagctacctcgcgggggctggcctggccttctccctaatcaagaacgctcagacccccagacgggggaccggcacgactggggagaccctcggcgagaagtggaagcgccagctgaactctctggaccgcaaggagttcgaggagtacaagcgctccgggattctcgaggtcgacagaacggaggccaagtcggccttgaaagacgggtccaagaccaagcacgccgtgagccgcggctccagcaaaatccggtggatcgtagagcgcggaatggtcaagccgaagggcaaggtggtcgaccttgggtgcggccgcggcgggtggtcctactacatggccaccctgaagaacgtcaccgaggtgaagggttacaccaaagggggcccggggcacgaagagcccatccccatggcgacgtacggctggaacctggtaaagttacacagcggcgtcgacgtattctacaagcctaccgagcaggtggacacactcctttgcgacatcggggagtcatccagcaacccaaccatcgaggagggccggactctgcgcgtcctcaaaatggtcgagccctggctgtcctccaagcccgagttctgcatcaaagtcctcaacccttacatgcccacagtgatcgaggagctggagaagctccagagaaagcacgggggcaacctggtgcgttgcccactgtcccggaacagcacccatgagatgtactgggtctccggcgcaagcggaaacatcgtgtccagcgtaaacaccacttccaagatgttgctgaaccgcttcaccacccggcaccgcaagcccacatacgagaaggacgtcgacctgggagctgggacacggagcgtgagcaccgagaccgagaagccggacatgaccataatcggccgccggctccaacgcctgcaggaagagcacaaagaaacatggcattacgaccaggagaacccgtaccggacctgggcataccacgggagctacgaggcgccctccacaggcagtgcctccagcatggtgaacggcgtcgtgaagctgctcaccaagccgtgggatgtgatcccaatggtcacgcagctggccatgactgacaccacccccttcgggcagcagcgcgtgttcaaagagaaggtggacacgcgcaccccccagccgaagcccggcacccgaatgatcatgaccacgaccgccaactggctgtgggccctcctagggaagaagaagaacccccggttatgcacccgcgaggagttcatcagcaaagtacggagcaacgcggccatcggcgccgttttccaggaggagcaggggtggaccagcgcttcggaagccgtgaacgacagccgcttctgggagttagttgacaaggaacgggctctgcaccaagagggcaagtgcgaatcctgtgtgtacaacatgatgggcaaacgcgagaagaagctgggggagttcggccgggccaaggggagccgggcgatatggtatatgtggctcggggccaggttcttagagttcgaggccctaggctttctcaacgaggaccactggtttggccgagagaactcctggagcggcgtggagggggagggcctgcaccgccttgggtatattcttgaggagatcgacaagaaggacggcgacctgatgtatgcagatgacaccgcaggctgggacactcggataaccgaggatgacctgcagaacgaggagttgattaccgaacagatggccccccaccacaaaatcctggcgaaggcgatcttcaagctgacgtaccaaaacaaggttgtaaaggtgctccggccgactccccggggcgccgtcatggacatcatcagccgcaaggaccagcggggcagcgggcaggtgggcacatacgggctgaataccttcaccaacatggaggtgcagttgatccgccagatggaggccgagggcgtgatcacgcaggacgacatgcagaaccccaagggcctaaaggagagagtagaaaaatggttgagagagtgcggtgtcgaccggctgaagaggatggcaatctccggcgacgactgcgtcgtgaagcccctcgatgagcggttcggtaccagcttattattcctcaacgacatgggcaaggtgcgtaaggacattccacaatgggagccttcgaagggctggaagaactggcaggaggtaccattctgctcacaccacttccacaagatcttcatgaaggacggccgatccctggtggttccgtgtcgcaaccaggacgagctgatcggccgggcccgcatctctcagggagcgggatggtcgctccgcgagaccgcctgccttggaaaggcctacgcccagatgtggtctctgatgtacttccaccggcgcgacctccggctggcctccatggcgatctgtagcgcggtcccgaccgagtggttcccgacaagccgcaccacctggtcgatccacgcccaccatcagtggatgaccacggaggatatgctgaaggtctggaatcgggtgtggattgaggacaaccccaatatgaccgacaagacccccattcatagctgggaagatatcccgtacctcggcaagcgcgaggacctgtggtgcgggtccctgatcggcctcagctccagggccacctgggccaagaacatccacacggcgatcacccaggttaggaacttaatcggcaaggaggagtacgttgactacatgcctgtaatgaagaggtactctgccccttccgagagcgagggtgtcctatga

SEQ ID NO: 26247 - RNA, 9867 nt, synthetic construct
  misc_feature 1..9867: note = derived and/or modified CDS sequence (opt11) from DENV-4__FJ850057__SS-prME
  source 1..9867: mol_type = other RNA
agcaccatcacgctgctctgtctgatccccactgcgatggccttccacctgtccactcgcgacggtgagcccctcatgattgtggcgaagcacgagcgaggtcgacccctgctgttcaagacgactgagggcatcaacaagtgcacgctcatagccatggaccttggtgagatgtgcgaggacaccgtgacctacaaatgccccctgcttgtaaacacggagcctgaggacatagactgttggtgcaacctaacgtccacctgggtcatgtacggtacctgcacccagtctggcgagcgccggcgcgagaagcgcagcgttgccctgacgccacactccgggatgggcctagagacccgggccgagacttggatgtcgagcgaaggggcatggaaacacgcacagcgcgtggagagttggatcttacggaatccaggcttcgccctgctcgccgggttcatggcctacatgataggccagaccggcatccagagaacggtgttcttcgtcctgatgatgctggtggcaccttcctacggcatgcgctgtgtaggcgtcgggaaccgcgatttcgtggagggcgtgagcggcggagcctgggtcgatctcgtgctggagcacggagggtgcgtgaccactatggcacagggcaagcccaccctcgacttcgagctcacgaagaccaccgcgaaggaggtcgccctgttacggacctactgcatcgaagcgtccatcagcaacatcacgaccgccactcgctgcccgacccagggtgagccctacctcaaggaggagcaggaccagcagtacatctgccggagggatgtagtggaccggggctgggggaacggctgcggcctcttcggcaagggtggggtcgtgacgtgcgccaagttctcttgcagcggcaaaatcaccggtaacctggtgcagatagagaacctcgagtacaccgtcgtggtgaccgtgcacaacggcgacacacacgcagtgggcaacgacacgagtaaccacggggtgaccgccactattacgccgaggagcccctctgtggaagtaaagctcccggactacggtgaactgaccctcgactgcgagccgcggtcggggattgacttcaacgagatgatcctgatgaagatgaagaagaagacctggttggtgcataagcagtggttcttagacctgcccctgccatggaccgccggagcggatacctccgaggttcactggaactataaggagagaatggtcacgtttaaagtcccgcatgccaaaagacaggacgtgaccgtgctcgggagccaagagggcgccatgcatagcgcactggcgggagctacagaggtcgactccggagacggcaaccacatgtttgccggccacctgaagtgcaaggtgcgcatggagaagctccgcatcaagggcatgtcctataccatgtgctccggcaagttcagcatcgataaggagatggcagagacgcagcatggcactaccgtggtgaaggtcaagtacgagggagcaggagcgccctgcaaggtgcccatagaaatccgtgacgtcaataaggagaaagtggtgggccgtgtcatctccagtacccccttggccgagaatacgaactccgttaccaacatcgaactagagccgcccttcggggacagctacatcgtgatcggcgtcggaaactctgctttgaccctgcactggttccgcaagggtagctccatcggcaagatgttcgagagcacctaccgcggagccaagcggatggctattctgggcgagacggcttgggacttcgggagtgtgggtggattgttcacaagtttgggaaaggctgtgcaccaggtttttggatccgtgtacacaaccatgttcggtggcgtgagctggatgatccgcattcttatcgggttccttgttctgtggatcggcacgaactcccgcaacacgagcatggccatgacctgcatcgccgttggcgggatcaccctgtttttaggttttaccgtgcaggcggacatggggtgcgttgtgtcctggagcgggcgagagttgaagtgcggttccgggatcttcgtggtagataacgtgcacacctggaccgaacagtacaagttccaacccgaatcccccgcccgtttggccagtgccatcctgaacgcccacaaagacggagtgtgcgggatccgctccaccacgagattggaaaacgttatgtggaagcagatcacgaacgagctgaattacgttctgtgggaagggggccacgacctaaccgtggtcgcgggcgacgtgaagggcgttctaaccaaaggtaagcgcgccttaaccccgccagtaagcgacctcaagtactcctggaagacctggggtaaagccaagatcttcacccccgaggcccggaacagcaccttcttgatagacgggcccgacacgtccgagtgcccgaacgagaggcgtgcgtggaacagcctggaggttgaggattatggcttcgggatgtttactaccaacatatggatgaagttcagagagggctccagcgaagtgtgcgaccaccgcctcatgagcgcggccatcaaggaccagaaggccgttcacgccgacatgggctattggatagaaagcagtaagaaccagacatggcagatcgagaaggccagcctgatcgaagtgaagacctgcctgtggcccaagacccacaccttatggtccaatggggtgctggagagccagatgctgatcccgaaatcctacgccgggcccttcagccaacacaactacagacaggggtacgccactcagaccgtcgggccgtggcacctcgggaaactggagatcgacttcggcgagtgccccgggacaaccgtgaccatacaggaggactgcgaccaccggggaccctctctgcgcaccactacagcttccggcaagctggtgacgcagtggtgctgccgcagttgcacaatgccgccccttaggtttcttggcgaagacggctgctggtacgggatggaaatccgccccctgaacgagaaggaggaaaacatggtgaaatcccaggtgacggccggccagggaacaagcgaaaccttcagtatggggctgctttgccttacgctgttcgtcgaggaatgcctgcggcgccgggtgactcgcaagcacatgatcctcgtggtcgtgataaccctgtgcgcgatcatccttggtggactcacctggatggacttactgcgtgccctcatcatgctgggcgacaccatgagcggtcggatcgggggccagatacatttagcaattatggctgtgttcaagatgtcccccggctacgtcctcggcgtgttcctgcggaagttgacgagccgagagactgctcttatggtcatagggatggccatgaccacagtcttgtcaatcccgcacgacctaatggagctcatcgacggcataagcctgggcctgatcctcctgaagatcgtgacacagttcgacaacacacaggtgggtactctggcactctcgttaacgttcatccggagcacgatgccactagtcatggcctggcgcactatcatggccgtgcttttcgtcgtaacccttatccccctgtgccggacctcctgcctccagaaacagagccactgggtggagatcacggccctcatcctgggcgcgcaggcgctgcccgtgtacctgatgacactcatgaagggggccagtaggagaagctggccgctcaacgaaggaattatggccgttggtctcgtgtctctgctcggcagcgcactgctgaagaatgacgtgcccctcgccggccccatggtggctgggggactgctgctcgccgcctacgtgatgagcgggagcagcgccgacctatccctggaaaaggccgctaacgtgcagtgggacgaaatggccgacatcaccggaagcagccccataatcgaggtcaaacaggacgaggacgggtcattctccatcagagacgtggaggagaccaatatgattacgctactggtgaagttagccctgatcaccgtctctggcctttatccacttgcgatccctgtgaccatgaccctctggtacatgtggcaagtgaagacccagcggtcgggggccttatgggacgttccgagcccggccgccacacagaaggctgccctgtcagagggtgtgtatcgtatcatgcagcggggcctcttcgggaaaacccaggtgggcgttgggatccacatggagggagtgttccacaccatgtggcacgtgacgcgcggcagcgtcatctgccacgagacgggtcggctggagccgagctgggccgacgtgcgcaacgacatgatcagctacggcggtgggtggcgattaggcgacaagtgggacaaagaggaggacgtccaggtcctagccattgaaccgggcaagaaccccaagcacgtgcagactaagcccggtctgttcaagacactgacaggggaaataggcgccgtgacactggattttaagccgggaacctccggcagccccatcataaatagaaagggcaaggtcatcgggctgtacggaaatggggtggtgacaaagtcaggcgactacgtaagcgcaattacccaggcggagagaatcggggagccggactacgaggtggacgaagacatattcagaaagaagcgccttactataatggacttgcacccgggagctggcaagacaaagcggatcctgccttccattgtgcgtgaggctctcaagagacgcctccggacgcttatcctcgcccctactcgcgtcgtggcggcagagatggaagaagctctgcgaggactacccattcgctaccagacaccagcagtgaagagcgagcacaccggacgggagatcgtcgacctgatgtgccacgccacattcacgacgcgcctactctcctcgacccgggtacccaactacaacctgatcgtcatggacgaggcgcacttcaccgaccccagctccgtggccgcccgagggtacatctcaacccgggtggagatgggcgaggccgctgcaatcttcatgactgccacccccccaggggcgacggacccgtttccccagtccaacagccctattgaggacatcgagcgcgagatcccggagcggagttggaacacaggcttcgactggatcacagactatcagggcaagacggtttggttcgtgccaagcatcaaggcggggaacgacattgcgaattgtttacgcaaatccggcaagaaggtgatccaattaagtcgcaagaccttcgacaccgagtaccccaaaacgaagctgacagattgggacttcgtcgtcacgaccgatatcagcgagatgggggcgaatttccgggctggacgcgtgatcgacccccgccgttgtttaaagccggtcatcctcacggacgggcccgagcgggtcatcctggccggccccatacctgtgacccccgccagcgcggctcagcgccggggccgtatcggtcgtaaccccgcccaggaagatgaccaatatgtcttttcgggcgaccccctgaagaacgacgaggaccacgcacactggaccgaggccaagatgctattggacaacatctacacccccgaggggatcatccccacactgttcgggcccgagcgagagaaaactcaggcgatcgacggcgagttcaggctgcgcggagaacaacggaagaccttcgttgagctgatgcgtagaggagatttgccggtgtggctctcgtacaaagtcgcctccgccgggatcagctacaaagaccgggagtggtgcttcaccggcgagcgcaacaaccagatactcgaagaaaacatggaggtggagatctggacgcgcgagggggagaagaagaagctgcggccccggtggttagacgcacgggtgtatgccgacccgatggcgctgaaggacttcaaggaattcgcttccggcaggaagagcatcaccctggacatcctcaccgagatcgcctcgctgcccacctacctgagctcccgcgcaaagttagccctggataacatagtcatgctgcataccacggagcggggcgggcgcgcgtaccagcatgccttaaacgagctgccagagtccctggagaccttgatgctggtggccctcttaggcgccatgaccgcgggtatcttcttgttcttcatgcagggcaaggggattggtaaactgtcaatgggcctaattgccatcgccgtagccagtgggctgctgtgggtcgccgaaatccagccgcagtggatcgcggccagcatcatcctagagtttttcctgatggtgctgctgatacccgagccggagaagcagcggaccccccaggacaaccagcttatctacgtgattctgacaatcctcacaataattggtctgatcgccgccaacgagatgggccttattgagaaaaccaagaccgacttcggcttctaccaagtcaagactgaaaccaccatcctcgacgtggacctgcgcccagcctcagcatggaccctgtacgccgtggccacgaccattctcacacccatgttacggcacaccatcgagaacacgtccgcaaacctgtcgctggccgccatagccaaccaggccgccgtcctaatgggtttaggcaagggatggccactccaccgcatggatctgggggttcccctgctcgcaatgggttgctactcgcaggtgaacccgaccacactgactgcgtcgctggtcatgctcttggttcactatgccatcattgggccaggcctgcaggccaaggctacgcgggaagcacagaagaggacggcagccggcattatgaaaaatcccaccgtggatgggatcaccgtgatcgacctagagcccatcagctacgacccgaagttcgagaagcaactgggccaagtgatgctgcttgtgctgtgcgcggggcagttactcctcatgcggacgacatgggccttctgcgaggtactgaccttagcgaccggccccacgttaacattgtgggagggtaacccaggccgcttctggaacacaaccatcgcggtgtcgacggcgaacattttcaggggttcgtacttggccggggcaggcctagcgttctccctgatcaagaacgcccagaccccccgccgggggacaggcactacgggcgagacccttggcgagaagtggaaaaggcagttaaacagcttagaccggaaagaattcgaggaatacaagcgatccggcatcctcgaggttgaccggaccgaggcaaaaagcgccctgaaggatgggtccaagaccaagcatgctgtcagccgcgggtccagcaagatccggtggatcgtggagcgcggaatggtgaagccgaaaggcaaggtcgtggacctgggttgcggccggggcggctggtcgtattacatggcaaccctcaagaatgtgacggaagtcaagggatacaccaaggggggccccggtcatgaggagcctatacccatggcgacctacggctggaacctggttaagctacacagcggcgtggacgtcttctacaagccaacagagcaggtggacacgctcctgtgcgacatcggtgaaagctcaagcaaccccaccatcgaggagggccggactttgcgcgtgctcaagatggtcgaaccctggctgtccagtaagcccgagttctgcatcaaggtgctgaacccctatatgcccaccgtcatcgaagaattagagaagctccagcgcaagcacgggggcaacctggtgcgctgtccgctgtcccgaaacagcacgcacgagatgtattgggtgtccggcgccagcggtaacatcgtttccagcgtgaacaccacctccaagatgctcctcaaccgtttcaccacccggcaccgtaagcctacctacgagaaggacgtggacttgggcgcgggtacccggtcggtatccaccgagacagagaagcctgatatgaccatcatcggacgcaggctccaacgactgcaggaagagcataaggagacctggcactatgaccaggaaaacccctatcggacctgggcttaccacgggtcgtacgaggccccatccacaggctccgcctcctccatggtcaacggcgttgtcaagctgctcacgaagccgtgggatgttatccccatggtgacccagttagcaatgactgacacgactccgttcgggcagcagcgagtcttcaaggaaaaggtggacacgcggaccccacagccgaagccaggcacgcgcatgatcatgaccacaaccgccaactggctatgggcgctgctgggtaagaagaagaacccccggttgtgcacgcgcgaggagtttatctccaaggtgcggagcaacgctgccatcggggcggtcttccaggaggagcaggggtggaccagcgcttccgaagctgtaaacgacagccgcttctgggagctcgtggacaaggagcgggcactgcaccaggagggcaagtgcgaaagctgcgtctataacatgatgggcaaacgcgagaaaaagttaggggagttcggaagagcaaaagggtccagagctatctggtacatgtggctcggcgcgcgctttctggagttcgaggcgttagggttcctcaacgaagaccactggttcgggcgtgagaactcttggagcggcgttgaaggggagggtttacaccggctggggtacatcctcgaagagatcgataagaaggacggggacctaatgtacgccgacgacaccgccggctgggacacacggatcacggaggacgacctacagaacgaagagctcattaccgagcagatggcgccccatcacaagatcctggcgaaggccattttcaaacttacctaccaaaataaagtcgtcaaagtgctcaggcctacccccagaggggcagttatggatatcatctcccgcaaagaccagaggggcagcgggcaggtcggaacctacgggctaaatacgttcaccaacatggaggtccagctgatccgtcagatggaggctgagggcgtgataacccaggacgacatgcagaaccccaagggcctcaaggagcgggtcgagaaatggctgcgcgagtgcggggtagaccggctgaaaagaatggccatctctggcgacgactgcgtggtgaagccactcgacgagagattcggcacctcattgctgttcctcaacgacatgggcaaagtgcgcaaggacatcccacagtgggagccttccaaagggtggaagaactggcaggaggtgcccttctgctcccatcacttccataagatattcatgaaggacggccgatccctggtcgtgccctgtcgcaaccaagatgagcttatcggacgggcgcgcatctcacagggagccggctggtccctacgcgaaacggcctgcctgggtaaggcatacgcccagatgtggagcctgatgtatttccaccgtcgcgatctccggctggcgtccatggccatttgcagcgcagtgcccaccgaatggtttcccacgagccgcaccacctggtcgatccatgcccaccatcagtggatgaccacggaagacatgctgaaggtgtggaatcgggtatggatcgaggacaaccccaacatgaccgacaagacgcccatccactcatgggaggacatcccttacttagggaagagagaggacctgtggtgtgggtccctgatcggcttgtctagccgggctacatgggcaaagaatatacacacggccatcacccaagtccgcaacctgataggcaaggaggagtatgtggattacatgcccgtgatgaagcggtacagcgccccttccgagtcggagggtgtgctgtga

SEQ ID NO: 26248 - RNA, 9867 nt, synthetic construct
  misc_feature 1..9867: note = derived and/or modified CDS sequence (opt11) from DENV-4__GQ199881__SS-prME
  source 1..9867: mol_type = other RNA
tccaccataaccctgctctgcctgatccccacggtaatggccttccacctttccacccgagacggtgaaccgctcatgatcgtcgcgaagcatgaaagaggtagacccctgctgttcaagacaaccgaggggatcaacaaatgtacgctgatcgcgatggatttaggtgagatgtgtgaggacaccgtgacctacaaatgccccctgctcgtgaacaccgaacccgaagacattgactgctggtgcaacctgaccagcacatgggttatgtacggtacgtgtacccagtccggggagcgtcgccgcgagaagcgcagcgtggcattgacgccacactccggtatgggcctcgagacgcgggcagaaacctggatgagctccgagggagcctggaagcacgcccagcgcgtggaatcctggatcctaaggaacccaggcttcgctctgctggctgggttcatggcctacatgataggccagacccgaatccagaggacggtcttctttgtgctgatgatgttagtcgccccctcctatggcatgcgctgtgtcggggtaggcaatcgggacttcgttgaaggggtgagcggcggtgcgtgggtggacctcgtgctggagcatggcggctgcgtaaccactatggcccagggaaagccaaccctagacttcgagttgacgaaaacgaccgccaaggaggttgcgcttctgcgcacctactgcattgaagcctccatctcgaatattacgactgcgacccggtgccccacccaaggtgagccatacctcaaagaggaacaggaccaacagtacatctgccgcagagacgttgtcgataggggctggggcaacggttgcggtctattcggcaaggggggggtcgtgacgtgcgcaaagttcagctgttcagggaagatcaccggcaacctagtccagatcgagaacctcgagtacaccgtggtcgtcaccgtgcacaacggggacacacacgcggtcggtaatgacaccagcaaccacggggtgacagctacaatcacgccacggagcccctccgtcgaggtgaagctgcctgattacggagagctgacactggactgcgagccacgcagtggcatcgacttcaacgaaatgatcctgatgaagatgaagaagaagacttggctcgtgcataaacaatggttcctcgacctgccattaccatggaccgcgggggcggacacctcagaagtgcattggaactacaaggagcggatggtaaccttcaaagtgccgcacgccaagcgccaggacgtcaccgtcctaggaagccaggaaggcgccatgcacagcgcgctggccggtgctaccgaagtagactcgggcgacgggaaccacatgttcgccggccacctgaaatgtaaggtgcgcatggagaagttgcggatcaagggtatgagctacaccatgtgctccgggaaattctcaattgacaaggagatggcggagacgcagcacggcaccaccgtagttaaggtgaagtatgagggcgccggcgctccctgcaaggtccccatcgaaattcgggacgttaacaaagaaaaggtggtggggcgtgtgatctcttctacccccctagccgagaacacgaactccgtgacaaacatagagctggagccgcccttcggagacagctatatagtcatcggtgttggcaactccgccctcaccctgcactggtttcgcaaaggcagcagcatcggtaagatgttcgagtcgacctaccggggcgcgaagcgaatggctatactgggggagacggcgtgggacttcggctcggtgggcggcctgttcaccagcctgggcaaggcagtccatcaggtgttcggctcggtgtacacaaccatgttcggtggggtcagttggatgatacggatactgatcgggtttctcgtgttatggatcggcacgaactcccggaacactagcatggcaatgacgtgcatcgcagtcggtggtataaccctattcctggggttcaccgtccaggcggacatgggctgtgtggtgtcatggtccgggcgggagctaaaatgtggcagcgggatcttcgtcgttgataacgtgcacacctggacggagcaatacaagttccagcccgaatcccctgcgcgcttagccagcgcgatcttgaacgcccacaaagacggtgtctgcggcatccgatccaccacgcgactcgagaatgtaatgtggaaacagatcacaaacgagctgaattatgttttatgggaagggggccacgatctcaccgtcgtggccggagacgtgaagggcgtgttaaccaagggcaagcgggccctgacgccgcccgtgagcgatctcaagtacagttggaaaacatgggggaaggcgaagatattcacacccgaagcgagaaattccacattcctgatagacgggcctgacacgtccgagtgcccgaacgagcggcgagcgtggaacagtctggaagtggaggactatggcttcggtatgttcaccactaacatctggatgaagtttagagagggatcctcggaggtctgcgatcatcgcctcatgtccgcagcgataaaggaccagaaggcggtccacgcggacatgggctactggatcgagagctccaagaaccagacctggcaaatcgaaaaggcttcgcttatagaggtgaaaacatgtctttggccaaagacccataccctgtggtccaatggcgtcctcgagagccaaatgctgatacccaagtcctacgcgggccctttcagccagcacaactatcggcaaggctacgctacccagacggtcgggccatggcacctgggtaaactggagatcgatttcggcgagtgtcccggcactacagtgaccatacaggaggattgcgaccatcgaggtccgagcctgcgtactaccaccgcatccggtaagcttgtcacacagtggtgctgccgttcgtgcacgatgccccccctgagattcctcggcgaagacgggtgctggtacgggatggagatccggcctctctctgagaaggaagagaacatggtaaagtcccaggtagccgcggggcagggtacatccgagactttctttatgggtttactttgtctaaccttattcgtggaggagtgcctaaggcgacgagtgacccggaaacatatgatcctcgcggtcgttattacgctgtgcgccataatactgggtgggttaacctggatggatttgctgcgcgccctcatcatgctgggggacaccatgtcagggcgaatagggggccagacccacctggccatcatggccgtgttcaagatgagccctggctacgtactaggagtgttcctgcgcaagctgacgtctcgggagacggcgctcatggtgataggcatggcgatgacaaccacgctgtccatcccgcatgacttaatggaactcatcgacggaatcagcctaggcctgatactcttaaagatcgtcactcagtttgacaacacgcaagtcggcaccttggccctcagcttaacgttcataagaagcaccatgtccctggttatggcctggaggacgatcatggcggttctctttgtggtgaccctcattccactgtgtcgcacgtcttgtctccagaagcagtcccattgggtcgagataactgcgctaatcctgggggcccaagccttacccgtatacctgatgaccctgatgaaaggcgccagcaggcgatcttggcccttaaatgaggggatgatggcagtggggctggtgagccttctcggctccgctttgttgaagaacgacgtgccccttgcgggcccgatggtggccggagggttattgctcgcggcctatgtgatgagcgggagctccgcagacctgagccttgagaaagccgctaatgtacagtgggatgagatggccgacatcaccgggtcgtccccaataatcgaggtgaagcaggacgaagacgggtccttctcaattcgcgatgttgaggagaccaatatgatcaccctcttggtgaagctggctctaatcaccgtttccggactgtaccccctcgcgatcccggtcactatgacgctctggtatatgtggcaggtgaaaacccaacgctcaggcgccctgtgggacgtcccctcccccgccgcaacccaaaaagccgctctctccgagggggtataccgcatcatgcagcgtgggctctttggcaagacccaggttggtgtgggcatccacatggagggggtctttcacacgatgtggcatgtgacgcggggctcggtaatctgccacgagaccggccgtttggaacctagctgggcggacgtgcgaaacgatatgatatcttacggaggcgggtggcggctgggcgacaagtgggacaaggaggaagacgtacaagtactcgccatcgagcccggaaaaaatcctaagcatgtgcagaccaagccaggcctcttcaaaaccctgacgggcgaaataggggctgtgaccctcgactttaagcccgggagctccgggagccccatcataaatagaaaagggaaagtcattggtttgtacgggaacggcgtcgttacaaagtcgggggactacgtgtcagcgatcacgcaggctgagcgaatcggcgagcccgactacgaggtcgacgaggacattttccgcaagaaacggctgacgatcatggacctccaccccggggctggcaagaccaaacggatcttaccgtccatcgtccgggaagccctgaagcgacggctgcgcaccctaatcctggcccccacccgcgttgttgccgccgagatggaggaggcattgcgagggctcccaatacggtaccaaacgcccgccgtgaagagcgaacacacaggtagagaaatcgtggacctaatgtgccacgcgacattcaccacaagactgctcagctcaaccagggtcccgaactacaacctgatcgttatggacgaggcgcacttcactgacccaagctccgttgccgctaggggctacatcagcacccgcgtcgagatgggggaagcagcggccatcttcatgacagccacccctcccggcgccacggaccctttcccgcagagtaacagcccgattgaggacatcgagcgggagataccagaacgctcctggaacaccggattcgactggatcacggattatcagggcaaaacggtgtggttcgtgccgtcgattaaggcaggcaacgatatcgcgaactgcctgcgcaagtctggtaaaaaggtaatccaattaagccgtaagaccttcgataccgaataccctaagacgaagttaaccgattgggactttgttgtcaccacggacatctcggagatgggcgccaacttccgcgccgggcgggtgattgaccccagacggtgtctcaagcctgtgatcctcacggacggtccggaacgggtcatcctggccgggcccatccccgttaccccagcgagcgccgcgcagcggcgcggacggatcggccgcaaccctgcccaagaagacgaccagtacgtattttccggagaccccttgaagaacgacgaggaccacgcacattggaccgaagcgaagatgctcctggacaacatatacacccccgagggcatcattccgacgctattcggtccggagcgggaaaagacccaagccatagacggtgaatttaggttacggggcgagcagcgaaaaacgtttgtcgagctaatgcgtcgcggggacctgcccgtctggttgtcatacaaagtggcctcagccggcatcagttacaaagatcgcgagtggtgcttcaccggtgagcgcaataatcagatcctggaggaaaatatggaggtcgagatctggacgcgtgagggcgagaaaaagaaactgcgcccccggtggctcgacgcccgcgtgtacgcggacccaatggcgctcaaggacttcaaggagttcgcctcgggcagaaagtctatcaccctcgacatactcacggagatcgcgtcactgcctacttacctgtcgtctcgggcaaagctcgcgttggacaacattgttatgttacacactacggagcgcggtggccgcgcgtaccagcacgccctcaacgaacttcccgaatcactggagacccttatgctggtcgcgctgctcggggcgatgaccgccggcatattcttgttctttatgcaggggaaaggtatcgggaagttatcaatgggccttatcaccatagccgtggcatccgggctgttgtgggtggccgaaattcagcctcaatggatagcagcttcgattattttagagttcttcctgatggtcctgctcatcccggagccggaaaagcagcgaactccgcaagataaccagctgatttacgtgatcctggctatactaaccattattggcctgatcgccgccaacgagatgggtttgatcgagaagaccaagaccgacttcggcttttaccaggtgaaaaccgagactaccatccttgatgtcgatctgcgtccggcatccgcctggacattatacgccgtagcgacaacaattctcacaccgatgctgcgacacacaattgagaacacaagtgcgaacttatccctcgctgccattgcaaaccaggccgccgtgctgatggggctggggaaaggctggcccctccaccggatggacctgggagtgcccctgctggcaatgggatgctatagccaggtaaaccccaccacattaactgcctccctggtgatgctgctggtccattatgcgatcataggcccggggctgcaggccaaggcaacgcgagaggcccagaaacggacagcagccggcattatgaagaaccctactgtagatgggatcaccgtgatcgacctcgagccaataagctacgacccgaagttcgagaagcagctgggacaagtgatgcttctcgtactgtgcgctggccagctgttgcttatgcgcacgacatgggcgttctgcgaggtactgacactcgccaccgggccgatcctgacgctatgggagggaaaccccggccggttctggaataccactatagccgtatccactgctaacatcttccgtggctcgtacctcgctggtgcgggactggcgttttcgctaattaagaacgcccaaactccccggcgaggtacggggactaccggcgagacattgggggaaaaatggaagcgtcagctgaactcgcttgaccgcaaggaattcgaggagtacaagcggtcaggtattctcgaggtcgaccgtactgaggccaaaagcgctctcaaggacggcagcaaaatcaaacacgctgtgtcaagagggtcctctaagatccgctggatcgttgagcgcgggatggtgaagccaaaggggaaggtcgtcgatttggggtgcgggcgcggcggctggagctattacatggccactctcaagaacgtcactgaagttaaggggtacacgaagggcgggcccggacacgaggaacccattcccatggccacgtacggatggaacctcgtcaagctgcactccggcgtggacgtgttctacaagcccacagaacaggtcgacacgctcctgtgtgacattggggaatcgtcctcaaatccaaccatagaggagggccgaactctgagagttctgaaaatggtggagccctggctgagtagcaaacccgaattttgcatcaaggtccttaacccctacatgcctaccgtgattgaagagctggagaaactccaacggaagcatggcgggaacctggtccggtgccccctgtctcggaactccactcacgaaatgtattgggtatccggggctagcggaaatatcgtttccagcgttaacacgactagtaagatgcttttgaaccgtttcaccacccgccaccggaaaccgacttacgaaaaggatgtagaccttggggcgggaactcgctctgtcagtaccgagaccgaaaagcccgacatgaccataatcgggcggcgcctacagcgcttgcaggaggagcataaagagacctggcattacgaccaagaaaacccataccgtacgtgggcataccacggcagctacgaggcccccagtactgggagcgcttcaagcatggtcaacggcgtggtgaaattactcaccaagccctgggacgtgatcccgatggtcacgcagctggctatgaccgatacaacacccttcggtcagcaaagagtattcaaggagaaagtcgatacgcgcaccccacagcctaaaccgggaacccgaatggtcatgaccacgaccgcgaactggctgtgggccctcctgggaaagaagaagaacccccgcctgtgcaccagagaagagttcattagcaaagttcgctctaacgccgccataggagcggtattccaggaggagcagggctggaccagcgcctcggaggccgtgaatgacagcaggttctgggagttagtggacaaagagcgcgcactccatcaagaggggaagtgcgagtcttgcgtttataatatgatgggcaagcgcgagaaaaagctgggcgagttcggacgggcgaaagggagccgcgccatatggtacatgtggctcggtgcgcggtttttggaattcgaggcgctggggttcctaaacgaggaccattggttcggccgggagaactcctggagtggggtcgagggcgagggtctgcaccgccttggctatatactcgaggagatcgacaaaaaggatggtgacttgatgtatgctgatgacactgcaggatgggatacccgcatcacagaggacgaccttcaaaacgaggagctcataaccgagcagatggctccccatcacaagatcctggccaaggctatcttcaagctgacgtaccagaacaaggtggtcaaggtattgcggcccacacctagaggcgctgtaatggatatcatctctcgaaaggatcagcgcggaagcggccaggtcggtacctacgggttgaatacctttaccaacatggaggtacagctgatccggcaaatggaggcggagggagtgatcactcaagatgacatgcagaaccccaagggcctcaaagaacgagtcgagaaatggctgcgggaatgcggcgtggaccgcctcaagcggatggccatatcgggcgacgactgcgtggtcaagcccctcgatgagcgattcggaaccagtttgctgttcctcaacgacatgggaaaggtgcggaaagacattccgcaatgggagccctccaaaggctggaaaaactggcaagaagtacccttttgcagccaccacttccacaagatcttcatgaaggatggacgatccctggtagtgccctgtcggaaccaggacgagctaatcggccgcgcccgcatcagccagggcgctgggtggtcactccgggagaccgcctgcctgggcaaggcatacgcccagatgtggtccctgatgtactttcacaggcgagacctccgtttggcgtcgatggccatctgtagtgcagtgcccaccgagtggttcccgacctcccggacgacctggtccatacacgcacaccaccagtggatgaccacggaggacatgctgaaagtttggaatcgcgtttggatcgaagataacccgaacatgatagacaagacccccgtacacagttgggaggacatcccctaccttggaaagagggaagacctgtggtgtggatccttgattggactctcatcccgcgcgacatgggcgaagaatattcacaccgcaataacccaggtccggaacctcatcggcaaggaggagtacgtagactacatgccggtgatgaaaagatacagcgcgccaagcgagagcgagggcgtcctttga

SEQ ID NO: 26249 - RNA, 9867 nt, synthetic construct
  misc_feature 1..9867: note = derived and/or modified CDS sequence (opt11) from DENV-4__GQ199882__SS-prME
  source 1..9867: mol_type = other RNA
tcaaccatcactttactctgtctgatccccacggttatggctttccacctgtccacccgcgacggggaacccctcatgatagtcgccaaacacgagcgggggcgccccctcttattcaaaaccaccgaaggcatcaacaaatgcacgctcatcgcgatggaccttggagagatgtgcgaggataccgtgacgtataagtgcccgctgctagttaacaccgaaccggaggacattgactgttggtgcaacctgacgtcaacctgggtcatgtatggaacctgcacacagtctggggaacggcggcgcgagaagcgcagcgtagccctgacgcctcattccggcatgggcctcgagaccagggccgagacctggatgagctccgaaggggcttggaagcacgcccagcgcgtggagagctggatcctgcggaatcccggcttcgcgctgctcgccggattcatggcctatatgatcggccagaccgggatacagcgcacggtattctttgtgctgatgatgttggtcgcgccgagctacggcatgcggtgcgtcggcgtagggaaccgcgactttgtggaaggcgtcagcggtggtgcgtgggtggacctcgtgcttgaacacggcgggtgcgtaaccaccatggcccaggggaaacccaccttagacttcgagctcactaagacgacagccaaagaggtagctctgcttcggacctactgcatcgaggcctccatcagcaacatcacaaccgcaactcgatgcccgacccaaggggagccatatttaaaggaggaacaggatcaacaatacatctgcaggagagacgtagtcgaccgggggtgggggaacggctgcggcctgtttgggaagggcggggttgtgacttgtgccaaattctcttgcagcggcaagattacggggaacctggtccagatcgaaaacctcgagtataccgtcgtggtcaccgtccacaacggcgacacgcatgccgtcggcaacgacacctccaaccacggggtcacagccaccatcacgccccgaagcccctccgtggaagtgaagctgcctgattacggcgagttgaccctggactgcgaaccacggagtgggattgacttcaacgagatgattctgatgaagatgaagaagaaaacctggctggtgcacaagcaatggtttctcgacttgccacttccctggaccgccggcgccgatacctccgaagtccactggaactacaaagagcgcatggtcacgttcaaagtgccgcacgccaagcggcaggatgtgacggtgctaggaagccaagagggcgcgatgcatagtgcactggccggggcgaccgaggtcgattccggggacggtaaccacatgttcgccggccacttaaagtgcaaggtccgcatggagaaactgcgcatcaagggtatgagctatacgatgtgttcgggaaagttcagcatcgacaaggagatggcggagacgcagcatgggacaaccgtagtgaaggttaagtatgaaggcgcaggggcgccctgcaaggttccaattgagatccgggacgtgaacaaggaaaaagtggtcggccgtgtgatctccagcacacccctggcggagaacacgaactcggtgaccaacattgagctagaaccaccttttggggacagctacatagtcatcggcgtgggcaactctgcgctcaccttgcattggttccggaaagggagttcgatcggaaagatgttcgaatctacttaccggggcgccaagcggatggctatactgggggaaacggcatgggacttcgggtccgtgggcggcctctttacctcgctcgggaaggccgtgcaccaggtgttcggctccgtgtacaccaccatgttcgggggtgtctcgtggatgatacgcattctgatcggatttctcgtgttatggatcggcactaactcccggaataccagtatggcaatgacatgcatcgcggtagggggcatcaccctcttcctgggcttcaccgtgcaggccgatatgggatgcgtggtctcctggtctggccgcgaactcaaatgcgggagcggcatctttgttgtcgacaacgtgcatacctggaccgagcaatacaagtttcagcccgagagtccggcgcggttagcctcagccattctgaacgcgcataaggatggtgtttgcggcatccgctccacgactaggctcgagaacgtgatgtggaagcaaatcaccaacgagttgaactacgttctgtgggaaggcgggcacgacttgacagtcgtggccggggacgtgaaaggcgtcctgacgaaggggaagcgggcgctgactcctcccgtgtcggacctcaaatactcctggaagacttggggcaaagcaaagatcttcactccggaggcacgaaacagcaccttcctgatcgatgggcccgacacgtccgagtgcccgaacgaacgccgggcctggaactctctggaggtggaagactacggtttcggaatgttcaccaccaacatttggatgaagttccgcgaggggtccagcgaggtctgcgaccatcggctaatgtccgccgctataaaggatcagaaggcggtgcacgccgacatgggttactggattgagagctcgaagaaccaaacctggcagatcgagaaggccagcctgatcgaggttaagacatgcctgtggccaaagacccacaccctgtggtcaaacggggtgctggagagccagatgcttattccaaagtcctacgcgggcccgttcagccaacacaattaccgccaaggttatgcaacccagacagttggcccttggcacctcggtaagctggagatcgatttcggggagtgccctggcacaaccgtcaccatccaggaggactgcgaccaccgggggcccagccttcgcaccacgaccgccagcggcaagctcgtcacccaatggtgttgcaggagttgtaccatgccgcccctccggttcttgggggaggacggctgctggtacggtatggaaatccgccccctatccgagaaggaggaaaacatggtgaagtcccaggtcgcggcgggccagggcacgtccgagacgttcagcatgggtctgctgtgtctcacactgttcgttgaggagtgcctgcggcgcagagtgacccgcaagcacatgatcctagcggtcgtgatcacgctgtgcgcgattatcctgggcgggctcacctggatggacttgctgcgggccctgatcatgctgggggatactatgtcgggccggatagggggccagacacacctggctatcatggccgtctttaaaatgtcccccggatacgtcctcggcgtgtttctgcggaagctgacgtcccgcgagacagcgctcatggtgatcggtatggcaatgaccaccaccttaagcatcccgcacgaccttatggaactgatcgacgggatctccctaggcctcatcttgctgaagatagtcacccagttcgacaatacacaggttgggaccctggccctcagccttacgttcatccggtccaccatgtcattagtgatggcctggcgaacaatcatggccgtcctcttcgtggtaacattgatcccactatgccggaccagctgcctccagaaacaaagccactgggtcgaaatcaccgcgctaatactgggcgcacaggcccttccagtttacttgatgacgctgatgaagggggccagcagacggtcgtggcccctcaatgaggggattatggcggtgggactggtttccctcctcggttccgccttacttaagaacgacgtcccgctggcaggccccatggtggccggtggcctgctcctcgctgcctatgtcatgtctgggagcagtgccgatttgtccctggagaaggctgctaacgttcagtgggatgagatggccgacataaccggaagctcacccataatcgaagttaagcaggacgaggacggcagcttctccatccgcgacgtcgaggagacgaacatgatcacgctcctggtcaagctggctctcataaccgtttcaggcctgtatcccctcgccatcccagtcacaatgacgctctggtacatgtggcaagtgaagacccagcggtccggcgccctttgggacgtccccagccccgccgcaacacagaaggcggccctatctgagggggtataccgaatcatgcagcggggtctcttcgggaagacacaggtgggcgtcggaatacacatggagggcgtattccataccatgtggcacgtgacgcgcggcagcgtgatctgccatgagacgggcagacttgaaccatcctgggcggatgtccgcaatgacatgatcagctatggcgggggctggaggctaggcgacaaatgggacaaggaggaggacgtgcaagtactcgcgatcgaaccgggtaaaaaccccaagcatgtccaaaccaagcccggactgtttaaaacattgactggggagatcggcgctgtaacgctcgacttcaaacccggtacctcgggctcaccgattattaaccggaagggtaaggtgatcgggctgtacggtaatggtgtcgtgacaaagtccggggactatgtctcggcgatcactcaggccgagcgcatcggggagcccgactacgaggtcgacgaggacattttccggaagaagcgccttaccatcatggacctacacccaggcgccggcaagaccaagcgaatcctgccctcaatcgttcgagaggccttaaagcggcgcctgcgcaccctcatcctggcgccaactagggtagtcgccgctgagatggaggaggccctgaggggcctcccaatccgctaccagactccggccgtgaaaagcgagcacactggccgggagattgtagacctcatgtgccacgcgacgttcacgacccgtctgctctcgtcgacccgggtaccgaattacaatctgattgtgatggacgaggcgcacttcacagaccccagctctgtcgccgcacgggggtacataagcacgcgggtcgagatgggcgaggccgccgccatcttcatgaccgccaccccacctggtgccaccgatcccttcccccagtccaactcccccatagaggacatcgagcgtgagatccctgagcgttcctggaatactggctttgactggatcacggactaccagggcaagaccgtgtggttcgtcccgtcaatcaaggccgggaatgacatcgctaactgtcttcgcaaaagtggcaagaaagtgatccagctctctcgcaaaaccttcgacacggaatatcctaagaccaagctaaccgactgggattttgtggtcaccaccgacatctccgaaatgggcgccaacttccgggccggccgggttatagacccgcgacgctgcttaaagcccgtgatcctcaccgacgggagcgagcgggtcatactcgcaggcccgatccccgtgaccccagcgtcggccgcccagcgccggggccgaatcgggcgaaaccctgcccaagaagacgaccaatacgtattcagcggggaccctttgaagaacgatgaggaccatgcccactggaccgaggcgaaaatgcttctggacaacatctatacgcccgaggggatcatccccacgctgttcggaccggagcgcgagaaaacccaagctatcgatggtgaatttagactgcgcggagagcaacgaaaaaccttcgtcgaactgatgcgcagaggtgacctgccggtttggctctcctacaaggtcgccagcgcggggatttcctataaggaccgggagtggtgtttcacaggcgagcgtaataatcagatattagaggaaaatatggaagttgagatatggacgcgggaaggggagaagaagaagctaagaccccgttggctcgacgctcgggtctacgctgaccccatggccttaaaggacttcaaggagttcgcgagtggccgcaagtctataaccctggatattttaaccgagatcgcctcactgcccacttaccttagcagccgcgcgaaattagcgttggacaacatcgtaatgctgcacacgaccgagcgcggagggcgcgcgtaccagcacgccctgaacgagctccctgaaagcctggagactctcatgctggtagccctgctcggcgcaatgaccgccggcatctttttgttctttatgcaaggcaaggggatcggcaaactgtccatgggcctcatcacgatagccgtagccagcggtctgttatgggtggccgagatccaaccccagtggatcgcggcgagtataatcttagagttctttcttatggtcctgctcatcccggaaccggaaaagcagcggactccccaagacaaccagctgatctacgtgatcttgacaatcctcaccatcattggcctgatagctgccaacgagatggggctcatagagaagacgaagaccgacttcggcttctaccaggtgaagactgagacaacgattttggacgtcgaccttcgacccgcgtcggcttggaccctatacgctgttgccactaccatcttgacgcccatgctgcggcacaccattgagaacacctccgccaacctatcgctcgcggcgatcgcgaaccaggccgctgtgcttatgggcctaggcaagggctggccgctccaccgcatggacctgggggttcccttgctcgccatgggctgctatagtcaggtgaatccgaccacgctgaccgcgagtctggtaatgcttctggtccactacgccatcattgggccgggcctgcaggccaaggccacccgggaggcccagaagcggaccgctgcgggcatcatgaagaacccaactgtggacgggatcaccgttatagatttggagcccatctcgtacgaccccaagttcgagaagcaattaggccaagttatgctgctcgtgctgtgcgcagggcaactgctcctgatgcggaccacctgggccttctgtgaggtcctgacgttggctacaggtcccatcctgaccctttgggaagggaatcctggccgattctggaataccacgattgcagtcagcacagccaacatcttccggggctcctacctcgccggtgcaggcttggcattctctctgatcaagaatgcacagacccctcgccgggggaccggcacgaccggggagaccctcggggagaaatggaaacgacagttaaactctctggaccggaaggagttcgaagagtataagagaagcgggatcctcgaggttgacaggactgaggccaagtccgcactgaaggacggcagcaagatcaaacacgctgtgtcccgcggcagcagcaaaatccggtggatcgtcgagagggggatggtcaagccaaagggaaaggtggtggacctggggtgcggccgcggcggatggtcatactacatggctaccctcaagaacgtgacggaagttaagggctacactaagggaggccctgggcacgaggaaccaattccgatggctacgtacgggtggaatctggtaaagctgcacagcggcgtggacgtgttctacaagcccaccgagcaagtcgacacactcctctgcgacatcggagagtccagctctaaccccacgattgaggagggacgcactttacgcgtgctcaagatggttgagccgtggctttcatccaagcccgagttctgcatcaaggtcctgaacccgtacatgcccactgttatcgaggagctggagaagctccagcggaagcacggaggtaacctggtccgctgccctttgtcgaggaactccacacacgagatgtactgggtgagcggcgccagtggcaacatcgtgtcaagcgttaacaccacaagcaagatgctcctgaatcgcttcacaacgcggcaccggaagcccacctatgagaaggacgtcgacctgggcgctgggacccggtctgtgagcaccgagacggagaagcctgacatgaccatcatcgggagacgccttcaaaggctccaagaggaacacaaggaaacctggcactacgaccaggagaacccttaccggacttgggcgtaccacgggagctacgaagccccaagcacgggctccgccagcagcatggtaaacggagtcgtcaagctgctcaccaagccctgggacgtgatccccatggtgactcaactggcgatgacagacacgaccccgttcgggcagcaacgcgtgttcaaggagaaggtagacacgcggacaccacagccaaagccaggcacccgcatggtgatgaccaccaccgccaactggttgtgggccctcctagggaagaagaaaaatccgcgtctctgcacgcgcgaggagtttatctccaaggtaagatctaacgccgccatcggcgcggtcttccaggaggaacagggatggacgtcagccagcgaggcggtgaacgacagccgcttttgggagctcgtggacaaagagcgggccctgcaccaggagggaaagtgcgagagctgcgtctacaacatgatgggcaagcgcgagaagaagttaggggagttcggccgcgccaaggggtctcgggcgatctggtatatgtggctcggcgcccgcttcctggaatttgaagcgcttggcttcttgaatgaggaccactggttcggacgagaaaactcatggtcgggcgtggaaggtgagggcctgcacagactcgggtacattctcgaagagatcgacaagaaggacggcgacttaatgtatgccgatgacaccgccggctgggacacccgtatcacggaggatgaccttcaaaacgaggagctcataacggagcaaatggcaccccaccacaagattctggcgaaagccattttcaagctgacctatcagaacaaggttgtgaaggtgttgcgccccaccccgagaggggccgtcatggacatcatcagccgcaaagaccagcggggttcggggcaggtcggaacctacgggttaaacacctttaccaacatggaggtacaactgatccggcagatggaagccgagggtgtcatcacccaggacgatatgcaaaaccctaagggccttaaggagcgagtcgaaaaatggctgcgcgaatgcggggtagaccggctgaagagaatggccatcagcggcgacgattgcgtggtcaaacccctcgatgagagattcggcaccagtctgctattcctcaacgacatgggcaaggttcggaaagatatcccccagtgggagccctcaaaagggtggaagaattggcaggaagtgccgttctgctcccaccacttccacaaaatcttcatgaaggacggacggagcttagtggtaccctgcaggaatcaggatgagcttatcggtcgggcgcggatctcccaaggggctggatggagcctccgcgagacagcttgcttgggtaaggcttacgcccagatgtggagcctgatgtactttcaccgtagggacctaagattggcgagtatggccatctgcagcgccgtccccaccgagtggtttcccaccagtaggaccacttggtctatccatgcccaccaccagtggatgaccaccgaggacatgctgaaggtctggaaccgggtctggatagaggacaatccgaacatgatcgacaagaccccagttcactcgtgggaggacatcccgtacttggggaaacgcgaggatctgtggtgcggtagccttatcggcctctcctcacgcgctacgtgggcgaagaacatccacaccgccatcacccaggtacggaacctaatcggcaaggaggagtacgtggactacatgcccgtgatgaagaggtattcggccccgtccgaatcagagggtgttctgtga

SEQ ID NO: 26250 - RNA, 9867 nt, synthetic construct
  misc_feature 1..9867: note = derived and/or modified CDS sequence (opt11) from DENV-4__GQ199883__SS-prME
  source 1..9867: mol_type = other RNA
agcactatcactcttctctgcctgatccccacggttatggccttccacctgtccacgcgcgacggcgagccgctcatgatcgtcgccaagcacgagcgggggcgacccctgctgtttaaaaccacagagggcatcaacaagtgtacgctcatcgcgatggaccttggggagatgtgcgaggacaccgtgacctacaagtgcccccttctcgtcaacaccgagcccgaggacatcgactgctggtgcaacctgacgagcacctgggtaatgtacggcacctgcacccagtcaggggagcgacgccgggagaagcgcagcgtggccctgacgccgcacagcggcatgggcctcgagacccgggcggagacgtggatgagctccgaaggggcctggaagcacgcccaacgcgttgaaagctggatcctgaggaaccccggcttcgcgctcctagccgggttcatggcctacatgattggccagaccgggatccagcgcactgtcttttttgtgctgatgatgctcgtcgccccctcctacggcatgcggtgcgtcggggtggggaaccgggacttcgtggagggcgtatccgggggcgcgtgggtggatttggtgctggagcacggcgggtgcgttactaccatggcccagggcaaacccaccttagacttcgagctcacgaagaccacagccaaggaggtggccctgctacggacctactgcatcgaggcctccatctcgaacatcacgaccgcaactcgctgcccaacccagggggagccatacctcaaggaggagcaggaccaacagtatatatgccggcgtgacgtggtagaccggggttgggggaacggctgcggcctattcgggaagggcggcgttgtgacgtgcgccaaattctcctgcagcggcaaaatcaccgggaacttagtgcagatcgagaacttggagtacacggtggtggtaaccgtacacaacggcgatacgcacgcagtcggcaacgacacctccaaccacggggttaccgccaccatcacgccacgcagcccctccgctgaggtaaagctgccggactacggcgagctgactctcgactgcgagccccggagcgggatcgacttcaatgagatgatattgatgaagatgaagaagaagacgtggttggtccacaagcagtggttcctcgacctgcctctgccctggaccgcgggcgccgacacttctgaggtgcactggaactacaaggagcgcatggtgacgttcaaagtcccgcatgcaaagcggcaggacgtgaccgtgctcgggagccaagagggcgcaatgcacagcgcccttgcaggcgccaccgaggtggactcaggggacggcaaccacatgttcgccgggcacctgaagtgcaaggtccgcatggaaaagctccgcatcaagggtatgagctacacaatgtgttccggcaagttcagcatcgacaaggaaatggcagagacccagcacgggaccaccgtcgtaaaggtcaagtacgaaggtgcgggggcgccctgcaaggtccccatcgaaatccgggacgtgaacaaggagaaagtggtgggccgcgtcatctccagcactcctctggccgagaacacgaactccgtaactaacatcgagctggagccgcccttcggagacagctatatcgtgatcggcgtcggcaactcagccctcaccctgcactggttccgcaaggggagctccatcggcaagatgtttgagagtacgtacagaggggccaagcggatggcgattctcggcgagacggcgtgggacttcgggtccgttggcggcctctttaccagcttggggaaggccgtgcaccaggtcttcggctcagtttacacaactatgttcggtggcgtgagttggatgatcaggatccttatcgggttcctcgtactgtggattggcactaactcccggaacaccagtatggccatgacgtgcatcgccgtgggggggattaccctcttcttaggtttcacggtgcaggcggacatggggtgtgtcgtgtcctggagcggtcgcgagctcaagtgcggcagcggcatcttcgtggtggataacgtacacacctggaccgagcagtacaaatttcagcccgagtcccccgcgagactggcctcggccatcctgaacgcccacaaggacggggtgtgcgggatccgctccaccacgcgactcgagaacgtcatgtggaagcaaatcaccaacgagctgaactacgtgttgtgggagggggggcacgacctaaccgtggtcgccggcgatgtgaagggcgtgctgacgaaggggaagcgggccctgacgccgcccgtctccgacctcaagtactcctggaagacctggggcaaggccaaaatcttcacccctgaggcccgaaacagcaccttcctgatagacggccccgacacctctgagtgccccaacgagagacgggcctggaatagccttgaggtggaggactacggcttcggtatgttcacgacaaatatctggatgaaattccgcgaaggcagcagcgaggtgtgtgaccaccggctcatgtccgcggccatcaaggaccagaaggccgtccacgcagacatgggctactggattgagagttccaagaaccagacctggcagatcgagaaggccagcctaatcgaggtgaagacgtgcctgtggccgaagacacacaccctctggtctaacggggtgctggagagtcagatgctgattcccaagagttacgccggcccgttcagccagcacaactaccgccaggggtatgccacccagaccgtcggcccatggcacctcgggaagctggagatcgacttcggggagtgccctggcaccaccgtaaccattcaggaagactgtgaccatcgggggcccagcctgagaaccacgaccgcctccggcaagctcgtgacccagtggtgttgccgctcctgtaccatgccgccccttcgtttcctcggggaagacggctgttggtacgggatggagatcaggcccctctccgagaaggaggagaacatggtcaagtcccaggtggctgccggccagggtacatccgagaccttctctatggggctcctctgcctcaccctgttcgtcgaggagtgcctgagacgccgggtgacccggaaacacatgatactcgccgtggtaatcacgttgtgcgccatcatcttaggcgggcttacctggatggacctgctgcgggccctcatcatgctgggcgacaccatgtccggacgcatcggggggcagactcacctggccatcatggcagtattcaaaatgagccccgggtacgtgttaggggtcttccttcggaagctgacgtcccgcgagaccgccctcatggtgatcgggatggccatgacgaccacgctgagcatcccccatgacctgatggagctcatcgacggcatttccctgggactaatactcctgaaaatcgtgactcagttcgacaacacccaggtcgggacactggccctcagcctgacgttcatccggtccaccatgagcttggtaatggcctggcgcactatcatggcggtgctgttcgtcgtgaccctgataccactgtgtcggacgtcatgcctccagaagcagagccactgggtggagatcaccgccttgatcctgggcgcccaggcattacccgtctacctgatgacattaatgaaaggggcgtcccgccggtcttggcccctcaatgagggcatcatggcggtggggctggtgtccctgctcggcagcgccctgctgaagaacgacgtcccgttggccggccccatggtggcggggggcctgctgctcgccgcctacgtgatgtccgggtccagcgccgacctttcactagaaaaggcggccaacgtccagtgggacgagatggcggatattacgggcagctcccccatcatcgaggtgaagcaggacgaggatggtagcttctcaatccgcgacgttgaggagacgaacatgatcactctcctggtcaagctggccctcatcactgtgagcggtctataccccctcgccatcccggtgaccatgacgctctggtacatgtggcaagtcaagacacagcgaagcggcgccctgtgggacgttccaagccccgccgcgacccagaaggccgccctgagcgagggggtgtaccgcatcatgcagcggggcctcttcgggaaaactcaggtcggcgtgggcatccacatggagggcgtgttccacaccatgtggcacgtcacacgcggcagcgtgatctgccacgagacggggcggctggaaccctcatgggccgacgtgcgcaacgacatgatcagctatggcgggggctggcgcctgggcgacaagtgggacaaggaggaggacgtccaggtgctcgccattgagccggggaagaaccccaagcacgtgcagaccaagcccggcctgttcaagaccttaacgggggaaatcggcgcggtcacacttgacttcaagcccggcacctccggcagcccgatcatcaatcggaagggcaaagtgatcgggctgtatggtaacggcgtggtcaccaagtccggggactacgtgagcgccattacgcaggcggagcgcatcggggagcccgactacgaagtagacgaggacatatttcgtaagaagcgcctgacgatcatggacctccaccccggcgccggcaagaccaagcgtatccttccgtccatcgttcgcgaggccctgaagcgccgcctgcgaaccttaatcctggccccgacgcgcgtggttgccgcggagatggaagaggccctgagggggcttccaatcagatatcagacccccgcggtaaaatccgagcacaccggccgagagatcgtggatttaatgtgccacgctacctttactacccgcctgctcagcagcacccgggtgccgaactataaccttatagtcatggacgaagcacactttaccgacccctcatccgtggccgcccgcggctacatcagcacccgtgttgagatgggcgaggcggccgccatcttcatgaccgccaccccccccggggccaccgacccgttcccccaatcgaactcacccatcgaggatatcgagagagagatccctgagcggtcctggaatacggggttcgactggatcaccgactaccagggcaagacggtatggtttgtgcctagcattaaagcgggcaatgacatcgccaactgcctgcgcaagtccgggaagaaggtaatccagctgagccgcaagacattcgacacggagtaccccaagaccaagctgaccgactgggactttgtggtgactacggacataagtgagatgggggccaatttccgggccggccgcgtcatcgaccccaggcgctgcctcaagcccgtgatcctcacagacgggccggagcgggtgatcctggcaggcccaatccccgtaacacccgccagcgccgcccagcgccgaggccgcatcgggcggaatccggcgcaagaggatgatcagtacgtgttctccggagaccctttgaagaacgacgaggatcacgcccactggacagaggcaaagatgctcctggataacatttacacgcccgaagggatcataccgaccttattcggtccggaacgcgagaagacccaggcgatcgacggcgaattccggctccgcggggagcagcggaaaaccttcgtcgagctgatgcgccggggcgacctgcccgtctggctcagctacaaggtcgcctctgccgggattagctataaggacagggagtggtgcttcacgggcgagcggaacaaccagatcctggaggaaaacatggaagtggagatctggacacgcgagggggagaagaagaagcttagaccccgttggctcgacgcgcgggtctacgcggaccccatggccctgaaggactttaaggaatttgcctcaggccgcaagagcataaccctcgatattctcaccgagatcgcgtccctgcctacctaccttagcagccgcgcaaagctagccctggacaacatcgtgatgctgcacacgactgagcggggcgggcgcgcctaccagcacgccctcaacgagttacctgagagtctggaaaccctcatgcttgtggccctgctcggcgccatgacagccgggatcttcctgttcttcatgcagggtaaggggatcggcaaacttagcatgggcctgataacaatcgccgtggcctccgggttgttatgggtggcggagatacagccccagtggatcgccgccagcatcatcctcgaattcttcctgatggtgctgctaatcccggagcccgagaaacagcggaccccccaggataaccagcttatctacgtcatcctggccattttgactatcatcgggctgatagccgcgaacgagatggggctgatcgagaagaccaaaactgactttgggttctaccaggtgaagacggagaccaccattctcgacgtggacctgcggcccgcctcggcctggaccctgtacgcggtcgccaccaccatcttaacgccgatgctgcggcacacgatcgaaaacaccagcgcgaacctgtccctggccgccatagccaaccaggccgcggtgctgatgggactagggaaaggctggcccctccaccgcatggacctgggggtgccattattagccatgggatgctacagccaggtcaaccccacgaccttgacggcctccctagtgatgctcctggtgcactacgccatcatcgggccgggcctgcaggcaaaggccacccgggaggcccagaagcgcaccgcagccggcatcatgaagaaccccaccgtagacgggatcacggtaatagacctcgagcccatctcttacgaccccaaattcgagaagcagctgggccaagtgatgctacttgtactttgcgcggggcaactgctccttatgcggaccacctgggccttctgcgaggtgctgaccctcgcaacgggcccgatcctgaccctttgggaggggaaccccggacgcttctggaacacgacaatcgccgtatccacagccaacatcttccggggctcgtacctcgccggagccggcctggcgttctcactgatcaagaacgcccaaaccccccgccgggggaccggcaccactggggagaccctcggcgaaaagtggaagcgccaacttaacagcttggaccgtaaggagttcgaggagtacaagcggtccgggattctcgaggtcgaccggaccgaagccaagtccgcactgaaggatggctcaaaaatcaagcatgccgtgagccgcggcagtagtaaaatccggtggatcgtcgagcgcgggatggtcaagcccaaaggcaaagtggtggacctggggtgcggccgcggtgggtggagctactacatggccaccctaaagaacgtcaccgaggtgaagggctatacgaaggggggcccggggcacgaggagcccattcccatggccacctacggctggaacctggtgaagttacactccggcgtcgacgtgttctataagcccaccgagcaggtggataccctgctgtgcgacatcggggagagctccagcaacccgaccattgaggagggccggaccttgcgcgtcctcaaaatggttgagccctggctgtccagcaagcccgaattctgcatcaaggttttgaacccatacatgccgaccgtcatcgaggagctggagaagctccagcggaagcacggaggcaatctggtgagatgccccctgtcgagaaacagcacccacgagatgtactgggtatctggcgcgagcgggaatatcgtgtccagcgtgaatacgacctccaagatgcttctgaaccgcttcacaacccggcaccgaaagcccacgtatgagaaggacgtggacctgggcgccggaacccggagcgtgtccaccgagaccgagaagcccgacatgacgatcatcggccgccggctccagcgcctgcaagaggagcacaaggagacctggcactatgaccaggagaacccgtaccggacctgggcctatcacggcagctacgaggccccctccaccggaagcgcctccagcatggtgaacggcgtagtgaagttgctaacgaaaccatgggatgtgatcccgatggtcacccagctggccatgaccgacaccacacccttcgggcagcagcgcgtgttcaaagagaaggtagacacacggaccccccagcccaaaccgggcacgcggatggtcatgacgaccacagccaactggttgtgggccttgctggggaagaagaagaatccgcggctgtgcacccgcgaggagttcatcagcaaggtgcggtctaacgcagccatcggcgcggtgttccaggaggagcaggggtggacgagcgcctcggaggccgtcaacgacagtcgcttctgggagctcgtagacaaggagcgagccctgcaccaagaaggtaagtgcgagtcgtgcgtgtacaacatgatgggcaagcgcgaaaaaaagctgggagaattcggccgtgccaaggggagtcgggcgatctggtacatgtggctcggcgcgcgcttcctggagtttgaggccctggggttcctcaacgaggaccactggttcggccgggaaaacagctggagcggggtagagggggagggcctgcaccgcctggggtacatcctcgaggagatcgacaagaaggatggcgatttgatgtacgccgacgacaccgccggctgggacacccggataaccgaggacgacctgcagaatgaggagctcatcacggagcagatggccccccaccacaagattctggccaaggccatcttcaagctgacctaccagaacaaggtggtgaaggtccttcggcccaccccgcgtggggccgtgatggacataatctcccgcaaggaccagcggggcagcgggcaggtgggcacctacgggcttaacacctttacgaacatggaggtccagctcatccgccagatggaggcggagggcgtgatcacacaggacgacatgcagaaccccaagggcctgaaggagcgggttgagaagtggctgcgcgagtgtggagtggatcgtctcaagcgcatggccatctccggagacgattgcgtggtgaagcccctcgacgagcggttcgggacgagcctgctgttcttgaacgatatgggcaaagtacgcaaggacatcccgcagtgggagccgtccaaggggtggaagaactggcaggaggtacccttttgtagccaccacttccacaagatcttcatgaaggacggccggtccctggttgtcccctgccgcaaccaggacgagctgatcggccgggcccgcattagccagggagccggctggtccctccgcgagactgcatgcctggggaaggcctacgcccagatgtggagcttaatgtactttcatcggcgcgatctccggcttgcaagcatggccatctgctccgcagtccccacggaatggttcccgacatctcgtaccacctggtccatccacgcgcaccatcagtggatgactaccgaagacatgctgaaggtgtggaaccgcgtctggatcgaggacaaccccaacatgatcgacaaaacccccgtgcacagctgggaggacataccctacttgggcaagcgagaggacctgtggtgcggttccttaataggcttgagctccagagcaacctgggcgaagaacatccatacggccataacccaagtgcgcaacctgataggcaaggaggagtatgtcgactacatgccggtgatgaagcggtacagcgcccccagtgagagcgagggggttctatga

SEQ ID NO: 26251 - RNA, 9867 nt, synthetic construct
  misc_feature 1..9867: note = derived and/or modified CDS sequence (opt11) from DENV-4__GQ199884__SS-prME
  source 1..9867: mol_type = other RNA
tcaacaattaccctcctatgtcttatccccaccgtgatggcattccatctctccacacgggacggagaacccctaatgatcgtcgccaaacacgagaggggccggccgctgctctttaaaacaacggagggcatcaacaaatgcacccttatagcaatggacctaggggagatgtgtgaagacactgtgacctacaaatgtccactattagtcaacacagaaccggaagacatagactgctggtgtaacttaacttcgacatgggtgatgtacggcacgtgcacccagtcgggggagcggcgaagggaaaaacgaagtgtagccctcacgcctcacagtggtatgggcctcgaaacgcgagccgaaacatggatgtcgtcggagggcgcttggaagcacgcccaacgggtagagagctggatactacgaaaccccggcttcgcactcctagctggctttatggcatacatgataggtcaaacgggcatccaacgaaccgtattctttgttctgatgatgctggtcgcaccctcatacggcatgcgttgtgtcggtgtcggcaatcgagacttcgtggaaggggtcagcggaggggcctgggtcgacctcgtattggagcacggcgggtgcgtgaccacgatggcgcaagggaagcccactcttgacttcgaactaacaaagacaacggcgaaggaagtcgcgctccttagaacatactgcattgaggcttccatctccaatatcaccaccgcaacacgatgcccaacccagggcgagccctacctcaaagaagaacaggaccaacaatacatctgtcgacgggacgtagtagaccgtggctggggaaacggatgcggattattcgggaagggcggagtagtgacgtgcgctaagttttcatgctcaggtaaaatcacgggaaacctggtccaaatcgagaacctagagtacacggtcgtagtaacagtacacaacggagacacccacgcagtaggcaatgacacatccaatcatggagtaacggcaactatcacgcccagaagtccctcagtagaagtaaaactgccagattacggcgagctcactctggactgtgagccgcgctcagggatagacttcaacgagatgatactaatgaagatgaagaagaaaacgtggctcgtacacaaacaatggtttctggacctacctctaccatggacagccggtgcagacacatccgaggtacattggaactacaaagagcggatggtcaccttcaaagtaccacatgctaagagacaggacgtcacagtgctaggcagccaagagggggccatgcacagcgcattagctggagcgactgaggttgactcaggggatggaaaccatatgttcgccggtcatctaaaatgtaaagtacggatggaaaaactaagaatcaaaggaatgagctacacaatgtgttcgggcaaattctccatcgataaagaaatggcagaaacacagcatggaactactgtggtgaaagtaaagtacgaaggggctggggcaccatgcaaggtccccattgaaattagagacgtaaacaaagaaaaagtagtgggtcgcgtaatcagctcgaccccactcgcggaaaacaccaactcggtgaccaacatagagctcgaaccaccctttggggactcatacattgtgataggcgtcggcaatagcgctttaacactacactggttccggaaaggaagctcgataggcaaaatgttcgagtcaacctacagaggcgccaaaaggatggctatactcggagagaccgcgtgggacttcgggagcgtgggtgggctctttacctcacttggaaaggcagtacaccaggtgtttggaagcgtatatacgacaatgttcggtggggtctcatggatgatacgcatacttatcggatttctggtactctggataggcacaaacagcaggaacacgtcgatggccatgacctgcatcgcagtgggcgggatcactttgtttctaggcttcacggtacaggccgacatgggttgcgtggttagctggagtggccgtgagctcaaatgcggaagcggaatcttcgttgtagacaacgtgcacacctggaccgaacagtataagttccaacccgagagtccagcccgtctagcaagcgcaatactaaatgcacacaaagacggcgtctgcggtatacgctcgacaacgcgactagaaaatgtcatgtggaaacaaataacaaacgagctgaattatgtcttgtgggaaggagggcacgatttaacagtagttgcgggcgatgtgaaaggagtactaacgaaaggcaagagggcacttacgccacccgtcagtgacctcaaatactcttggaaaacctggggaaaagcaaaaatcttcaccccagaggcccgcaacagcacatttctgatagacggccccgacacaagtgaatgtccgaacgagcgacgggcgtggaacagtctcgaagtagaagattatggattcggtatgtttaccaccaacatttggatgaagttcagggaggggagctccgaggtatgcgaccaccgactaatgtctgccgccatcaaagaccagaaggcagtacacgctgacatgggctactggatagagagctccaagaaccaaacctggcaaatcgagaaggcaagccttattgaagtaaaaacctgtctctggccgaaaacacacacgctatggtccaatggtgtgctggaatcccagatgctcatcccgaaatcctacgccggtccattcagtcaacacaactaccgacaggggtatgctactcaaaccgtcggcccgtggcatttaggcaagctcgaaatagacttcggagaatgcccaggcaccaccgtaacgatccaggaagactgtgaccacagaggtcccagcctaagaacgaccacggcgtcagggaagttggtaacacaatggtgttgccgatcctgcacaatgccgcctttacgcttcttaggagaagatggttgctggtacggcatggaaattagaccattatcggaaaaggaagaaaacatggtaaaatcccaagttgccgccggccaggggacgtcagaaacattctcaatggggctcttatgcttgactctcttcgtggaagaatgtttaaggcgaagggtgacacgaaagcacatgattctggccgtagtgattactctatgtgcaatcatcctaggaggactaacctggatggacttgctccgagccctgataatgctcggtgataccatgagtggtagaattgggggtcagacacacctcgccatcatggcagtattcaaaatgagtccggggtatgtcctcggcgtctttctaaggaagctaacgagtcgcgagaccgcactcatggtaatcggaatggcaatgacgaccacattatccataccccatgacttgatggagttgatcgacgggatatccctgggattaatcctcctgaagatcgtcacgcaattcgacaacacccaagtaggcacacttgccctcagcctaacattcatcaggagcaccatgagtctagtcatggcgtggcggacaataatggcggtactgttcgtagtgacactgataccactgtgccgaacatcctgcttgcaaaagcagtcccactgggtagaaataacagcactaatcctgggcgctcaggcgctgccagtctacctcatgaccctgatgaagggggcatcgcggagatcgtggccactcaatgaaggaattatggcagtgggtcttgtatcactcctcggaagcgcgctcctgaaaaacgacgtcccacttgccgggccaatggtcgccggtggtctattacttgcggcttacgtcatgtcgggttcaagcgcggatctatccctggagaaagccgccaacgtacagtgggacgaaatggccgatataacaggaagctcgcctataatagaggtaaaacaagacgaggacggtagcttcagcatccgggacgttgaagagaccaacatgataaccctactcgtcaaactagcgctcataactgtcagcggcttgtacccactagctatacctgtgacaatgactctgtggtacatgtggcaagtaaagacgcaacgctcaggagctttatgggatgtgccgagtccggcagccacacaaaaggccgccctctcggaaggtgtgtaccgaatcatgcaacgagggctctttggaaagacccaagtcggagtgggcatacacatggagggagtattccacacaatgtggcacgtcactagaggcagcgtgatttgtcacgaaacggggcgcctcgaaccatcctgggccgacgtccgaaacgacatgatctcctacggaggtgggtggaggcttggagacaagtgggacaaagaagaagatgtccaggtactcgccattgagccgggaaagaacccgaagcatgtccaaaccaagccaggattatttaaaacattaacaggggaaataggagcggtaactctggattttaaacccggcacgagcgggtcacccattatcaacagaaagggcaaagtgatcggattgtacggaaacggagtcgtaaccaaaagtggcgactatgtctcggccatcacacaagcggagcgcataggggagccggattatgaagtcgacgaggacatattccgtaagaaacgtctaacaataatggacctgcaccccggcgctggaaaaacaaagagaatcctaccgtctattgttcgagaggcgctaaaacgccggttacggacactcatactcgcaccgacgcgagtagtagccgcagagatggaagaagccctacgtggacttccaatacggtaccaaacacccgcagtgaaaagcgagcacacaggccgagaaatcgtcgatctcatgtgtcacgcgacttttacaacccgccttttaagcagcacaagagttcctaattataatctaatagtcatggatgaagcccacttcactgatcctagctcggtggctgcccggggatatatctcgaccagggtggagatgggcgaagctgcggcaatcttcatgaccgcaacaccaccaggtgcaacggaccccttccctcaatccaactcacctatagaagacatcgaaagagagatccccgaaagatcgtggaataccggattcgactggataaccgactaccaaggtaagacggtgtggttcgtcccctccattaaagcgggtaacgacattgcgaactgtctcaggaaaagcggcaaaaaggtcatacagctgagtcgcaagacctttgacaccgagtatcccaagacaaaactgacagactgggactttgtcgtcacgaccgatatcagtgaaatgggagccaacttccgcgcagggcgcgtcatcgacccaaggcgatgcttaaagcccgtaattctgacagacggccctgaacgggtaatactcgcaggccccatacccgtgacacccgcatccgctgcccagcgcagaggcaggataggccgaaaccctgcgcaagaagacgaccaatatgtattcagcggagaccccctcaagaacgatgaagaccacgcccactggacagaggcaaaaatgctgctcgataacatatacaccccggaagggataatcccaacgctgttcggcccagaaagggagaaaacacaagcaatcgacggagagttccgattacggggagaacaaagaaaaacattcgtagaacttatgcgtagaggggatttacccgtatggttatcgtacaaggtagcatcggcgggtatcagctacaaagaccgagaatggtgtttcacaggggaacgtaacaaccagatattagaagagaacatggaagtagagatttggacaagggaaggggagaagaagaaattacggccgaggtggctggacgcccgagtttatgcagaccccatggcccttaaagactttaaagagttcgcctccggccgcaagtccataacactagacatacttacagaaatcgcgtccctaccgacctacctctcaagcagggctaagttggccctggataacattgtaatgctccacaccactgaaaggggtggcagagcctaccaacacgcattgaacgaactccccgagtcacttgagacactcatgctagtagcactgcttggggcgatgaccgccgggatttttcttttcttcatgcaggggaaagggataggcaagctaagcatggggctcatcacaatcgcagtggcaagcggcctgctatgggtagcggagatacagcctcagtggattgcagccagtatcatactagaatttttcctaatggtcctcctgatacccgagcccgaaaagcaacggacgccccaagacaaccagttaatatacgtcatactggccatcctcaccatcataggcctaatagcggccaacgaaatgggactgatagagaagactaagacggacttcggtttctatcaagtcaagaccgagacgacaatactagacgtagacctacgccctgcatccgcgtggacgctatacgccgttgcaacgaccatacttacaccgatgttgcgccacaccattgaaaacacgagcgcaaacctttcgctagccgcaatcgcgaatcaagcagccgtccttatggggctggggaaaggatggccgctacacaggatggaccttggtgtccccctactcgctatgggctgctatagtcaggtcaacccgaccaccctcacagcaagtttggtcatgttactggtacattacgcaatcataggtccaggactacaagccaaagcaacgcgggaggcccaaaaacggacagcagcggggataatgaaaaatccaaccgtagatggaatcacggtgatcgacttagagcctataagctacgacccgaaattcgaaaagcagttaggccaggtaatgttgttagtgttatgtgcgggacaactactcctcatgcgaaccacatgggccttctgtgaagtacttaccctggcaaccggccccatcctaactctatgggaagggaatcccggcaggttctggaacaccaccattgcggtaagtaccgcaaacatcttccgcggctcgtacctggctggagctggcctggcattctcgctcattaagaacgcccaaacaccgagacggggcaccggcacaaccggggagacactaggagaaaaatggaaacggcagctgaactcccttgaccggaaagaatttgaggaatacaagaggtctggcatcctcgaagtcgaccgaacggaagcaaaatcggcactcaaagacggcagcaaaatcaagcacgccgtaagccgaggatccagcaaaatcaggtggatcgtcgagcgaggaatggtaaaacccaaaggcaaagtcgtagacctggggtgtggccgcggaggttggagctactacatggcaacactcaaaaacgtaacggaagtgaaaggttatacaaaaggaggaccaggacacgaagaaccaatccccatggccacgtacggatggaacttggttaaactgcactccggcgtagatgtattctacaagcctacagagcaggtcgataccttactttgcgacataggcgagagttcgtcgaaccccacaattgaagaaggacgtaccctgcgcgtactcaagatggtagaaccatggctatcgagtaagcccgagttctgcatcaaggtacttaacccctacatgccaacagtaattgaagaactagaaaaactccagaggaagcacggagggaacctcgtgcgatgtccactctcaaggaactcaactcacgagatgtactgggtgagcggggcgtccggcaacatagtatcatcggttaacacaacaagcaagatgctactaaatagatttacaacgcggcacagaaaacccacttacgagaaagacgtagacttaggcgcgggcacaagatcagtcagcacggagacagaaaagccggacatgacgatcattggcagacgactacaacgattgcaggaggaacacaaagagacctggcactatgaccaggaaaacccatacagaacatgggcctaccacggaagctacgaagccccttccacaggtagcgcaagtagcatggtcaacggagtagtgaagctgcttacaaagccatgggatgttatcccaatggtcacgcaattagcgatgactgacacgacaccgttcggccagcaaagagtgtttaaagaaaaagtcgacacacgcaccccgcaaccaaaaccgggtacccgtatggtcatgaccacgacagctaactggctatgggcattgctcggcaagaagaaaaacccaagactctgcacacgcgaagagttcattagcaaagtgcgaagcaacgccgcaatcggcgccgtcttccaagaagaacaagggtggacgtcagcgtcagaagccgtaaacgatagcaggttttgggaactggtagacaaagaacgagcgctacaccaggagggaaagtgtgaatcttgtgtatacaacatgatggggaaacgagaaaagaaacttggcgagttcgggagggcaaaaggctcgcgggccatctggtatatgtggctaggagcgcgcttcctggagttcgaggccctaggctttctcaacgaagaccactggttcgggcgagaaaattcatggagcggcgtagaaggagaaggcctgcaccggttaggctatattttggaagaaatcgacaaaaaggacggtgacttaatgtacgcagacgatacggccggatgggatacaagaatcaccgaggatgacctccagaatgaggaactcataaccgaacaaatggcaccccaccacaagatactcgcgaaagcaatattcaagctaacttaccaaaacaaggtggtcaaggtattaagacccacgccacgaggagcagttatggatataatctcccgaaaagaccaaagaggaagcggccaggtagggacatacggactgaacaccttcaccaacatggaagtacaactcatccggcaaatggaagctgaaggcgtcataacgcaggacgacatgcagaacccgaaaggtctaaaagaaagggtagagaagtggcttcgagaatgtggggtcgatcgtctcaaaaggatggcaataagcggggacgattgcgtcgtcaagccgctagatgagcgcttcggcacaagcctcctgttcttaaacgacatgggcaaagtgaggaaagacatcccacagtgggaaccgtcaaaaggttggaaaaattggcaagaagtacccttttgcagccaccacttccacaagatatttatgaaggacggacgcagcctagtcgtcccctgccgaaaccaagatgaactaattggaagggcccgcataagtcaaggggccgggtggagcctgcgcgagactgcatgcctaggtaaagcgtacgcccaaatgtggtcgttgatgtattttcacagacgagacctacgcctagcgtccatggccatatgcagcgcggtccccaccgaatggttcccgactagccgaaccacatggagtattcacgcccaccaccagtggatgaccacggaggacatgctcaaggtatggaaccgggtatggatcgaagataacccaaacatgattgataaaacccccgtccactcttgggaggacatcccctacctgggcaaacgggaagacttatggtgtggctcactcataggtctctccagccgagccacgtgggctaaaaacatccacaccgcaatcacccaggtgcgcaatctgatcggtaaagaggagtatgtagactacatgccagtcatgaaaagatatagtgctccctcggaatctgaaggagtcctgtga

SEQ ID NO: 26252 - RNA, 9867 nt, synthetic construct
  misc_feature 1..9867: note = derived and/or modified CDS sequence (opt11) from DENV-4__FJ882595__SS-prME
  source 1..9867: mol_type = other RNA
tcaacaatcaccctgctctgcctgatccccacagctatggccttccatctgtctacgcgagatggcgaaccgctcatgattgtggcgaagcacgaacgagggcgaccgctgttgttcaaaacgacggagggcatcaataagtgcacgttaatcgcaatggacctgggggagatgtgtgaagataccgtcacctacaagtgccctctgctcgtcaacaccgaaccagaggacatcgactgctggtgtaacctgacgagcacgtgggttatgtacgggacgtgcacccagagcggggaacggcgccgggagaagcgcagcgtggccttgacgccgcactccggcatgggcctcgagacccgggccgaaacatggatgagctccgagggcgcctggaagcacgcccagcgcgtggagagctggatcctgcggaatcccggcttcgccctgttagccggattcatggcttacatgatcggtcaaaccgggatacaaaggacggtgttctttgtcctgatgatgctggtggcgccctcctatggcatgcgatgcgtgggcgtcgggaaccgcgacttcgtcgagggtgtcagcgggggcgcctgggtggacctcgtgctggagcatggcgggtgcgtgaccaccatggcccagggcaagcccaccttggactttgagctgacgaagaccaccgctaaagaagtcgccctgctgcggacctactgcatcgaggcgtccatctctaacataacgaccgccacccgatgtccgacccaaggggagccatacctcaaggaggaacaggaccagcagtacatctgccgtcgggacgtggttgacaggggctgggggaacggctgtggcctgttcgggaagggcggcgttgtcacgtgcgcgaagttctcctgcagtggaaagatcaccggcaaccttgtgcagatagaaaacctcgagtatacggtcgtggtaaccgtacacaatggagacactcacgctgtaggcaacgacacatccaaccatggagtcactgccaccatcacgccccgcagcccctcggtggaagttaagctgccggattacggggagctgaccctggattgcgagcctcggagcggaatcgacttcaacgaaatgatcctgatgaaaatgaagaagaagacatggctagttcacaagcagtggttcctcgaccttccgttgccctggactgcaggtgccgatacatccgaggtacactggaactacaaagagcgtatggtgacgttcaaggtcccgcacgcgaaacggcaggatgtcacagtactcgggtcgcaggaaggcgcgatgcacagtgcacttgcaggtgcaaccgaggtcgattccggtgacgggaatcatatgttcgctggccatctcaagtgtaaggtgcgtatggaaaagttacgcatcaagggcatgagctacaccatgtgctccgggaagttctcgatcgataaggagatggcggaaacgcaacatggtaccacggtggtaaaggtgaagtatgagggagccggagcgccctgcaaggtgcccatcgagatccgggacgtcaacaaggagaaggtggtggggcgtgtcatctcgagcacccccttggccgaaaacactaactctgtgacgaatatcgagttagagccgcccttcggggactcctatatcgtcataggagtcggcaactccgcattaaccttacactggttcaggaaggggagttcaatcggaaagatgttcgagagcacctaccgcggggcaaagcggatggcgattctgggcgagacagcctgggatttcgggagtgttgggggactcttcacaagcctggggaaagcagtgcatcaggtcttcggctccgtgtacaccaccatgttcggaggcgtgagctggatgatccgtatcctgataggcttcctcgttctctggatcggcacgaatagcaggaacacctccatggccatgacctgcatcgccgtgggcggaatcaccctcttcctgggcttcacggtgcaagcggacatggggtgcgtcgtgtcctggagcggcagagagctcaagtgcgggagcggcatattcgtggtcgataacgttcatacgtggactgagcagtacaagttccagcccgagtcccccgcacggcttgccagcgccatccttaacgcccacaaggacggcgtgtgtggaattcgttccaccacgcgactcgagaatgttatgtggaagcagattaccaacgagctcaactacgtactgtgggagggtgggcacgacctcacagtcgtcgcaggcgacgtgaaaggcgtgctgacaaaagggaagcgtgcgctgacgccgcccgtgagcgacctcaagtacagctggaagacctggggcaaggccaaaatcttcacccccgaggccaggaacagcacctttctgatcgacggtcccgacacatccgagtgcccaaacgagcgcagagcctggaacagcctcgaagtggaggactacggcttcggaatgtttactaccaacatctggatgaagttccgcgaaggctcctcggaggtgtgcgaccaccggctcatgtctgcggccatcaaggaccagaaggccgtacatgccgatatggggtactggattgagagctccaagaaccagacgtggcagatcgaaaaggcgagcctaatcgaggtgaagacgtgtctgtggccgaagacacacaccctctggtccaacggggtgctggaaagccagatgcttatacccaagtcctacgcgggaccgtttagccagcacaactaccgccaaggatacgccacccagaccgtgggcccctggcacctcgggaaactggagatcgacttcggcgagtgcccgggtacgacggtgaccattcaggaggactgtgaccaccgggggccaagcctacggaccacgaccgcttccggcaagctcgttacccaatggtgttgccgcagctgcaccatgccaccgcttcggtttctgggggaggacggctgctggtacgggatggagatccggcccctctcagagaaggaggaaaacatggttaagagccaggtggccgcgggacagggcacgtccgagaccttctcaatgggtctgctctgtctcacactgtttgtcgaggagtgcctgcggcgacgtgtgacccgcaagcacatgatcttggccgtggtcatcacgctctgtgccatcatcctcggcgggctgacctggatggacctcctgcgggccctaataatgcttggtgacaccatgtccggccgaatcggggggcagacccatcttgccatcatggcggtgttcaagatgtctcccggttacgtactcggcgtattccttcgcaaactgacttcgcgagagaccgcgctcatggtgattgggatggccatgaccaccacgctaagcatcccgcacgacctaatggagctcatcgacggcatttccctggggctgattctcctgaagatcgtgacccaattcgacaacacccaggtcgggacgctggctttgagcctgacgttcataaggtccacgatgtcactggtgatggcctggcgcacaatcatggcggtgctatttgtcgtgactttaatccccttatgccggaccagctgcctccagaaacagtcgcactgggtggagataaccgccctgatcctgggcgcccaggccctccctgtctacttaatgaccttaatgaaaggggcgtcacgccggagttggcccctcaacgagggcatcatggctgtcggtcttgtatcactgctcggctctgccctgctgaagaacgacgtcccactagccggccccatggtagccgggggcctcttactcgcggcctacgtgatgtccgggtctagcgccgacctaagtctggagaaggccgccaacgtccagtgggacgagatggcggacattaccggcagctcccccatcatcgaagtgaaacaggacgaagatgggtctttctctataagggacgtggaggagactaacatgatcacccttctggtcaagctggccttaatcaccgtgagcgggctctacccattggccatacccgtgaccatgacgctctggtacatgtggcaggtaaagacccagcggtccggcgccctgtgggatgtgccgagccccgccgcgacccagaaggccgccctgtccgagggggtgtacagaatcatgcagcgaggcctcttcggtaagacgcaggtgggggtggggatccacatggagggcgtcttccacaccatgtggcatgtcacacgcggcagcgtgatctgccacgagaccggacggcttgaaccctcctgggcagacgtgcgcaacgacatgatcagctacggagggggctggcgcctgggtgacaagtgggataaggaagaggatgtacaagtcctagccatcgaaccgggtaagaacccgaagcacgtgcagacgaagcccggcttgttcaagacccttacgggggagatcggcgctgtcactttggacttcaagcccggtacatccggtagccctataatcaatcggaagggcaaggtgatcggactgtacggcaatggggtggttaccaaatcgggcgactacgtgtccgcaatcacgcaggcagagcgcatcggagagcccgactacgaggtggacgaggacatcttccggaagaagcgcctgaccatcatggacctccaccccggcgcgggcaagaccaagcgcatcttgccctcgatagtccgcgaggccttaaagagaagactgcggactcttatcctggcacccacgagagtcgtggccgccgagatggaggaggctctacgggggctccccatccggtaccagacgccagctgtcaagagcgagcacaccggaagagagattgtcgacctgatgtgtcatgccacttttaccacgcgcctgctttctagtacccgggtgcctaactacaacctgatagtcatggacgaggcccatttcactgacccgtcttccgtggccgccagagggtacatcagcacgcgggtcgagatgggcgaggcggccgccatcttcatgactgctacgccccccggagctacagacccgtttccccagtcaaacagccccatagaggacattgagcgagagatccccgaacggtcctggaacacggggtttgactggatcacggactaccagggcaaaaccgtgtggttcgtaccgagcattaaagcgggcaacgacattgccaactgcctgcgtaagtccgggaagaaagttatccagctctctcggaaaaccttcgacacggagtaccccaagaccaagctgaccgactgggactttgtggtgacaacggacatctccgagatgggggcaaacttccgcgccggcagagttatagacccccggcgctgcctgaagccggtgatcctcactgacggcccggaacgggtgatactggcagggcccatccctgtcactcccgccagtgccgcccaacgccggggccgcattgggcgcaacccagcccaggaggatgaccagtatgtgttcagcggcgaccccctgaagaacgacgaggaccatgcgcactggaccgaagccaaaatgctactagacaatatttacacgccggaagggatcatccctaccctgttcggcccggagagagagaagacccaggccatcgacggcgagttccgactccgtggtgagcagcggaaaaccttcgtcgagctgatgcgccggggggacttgcccgtttggcttagttacaaggtggcgtcggctgggatctcctacaaggaccgcgagtggtgtttcacgggcgagcggaacaatcaaatcttagaggaaaacatggaggtagagatctggacccgcgagggggagaagaagaagctgcgcccccgctggctcgacgcgcgagtctacgcagacccaatggccctgaaagacttcaaggagttcgcatccggccgcaaaagcataaccctggacattctcactgagattgcctccctgccaacatatctaagcagccgcgcgaagctagcccttgacaacatcgtgatgctgcacaccaccgagcggggaggtcgcgcttaccagcacgccctcaacgagctgcccgagtccctagagactctcatgctcgtggctctgctcggggccatgaccgccgggatcttcctgttctttatgcagggtacgggcatcggaaaactaagcatgggccttatcaccatcgcagtcgccagtgggctgctgtgggtggcggaaatccagccccaatggatcgcggccagcatcattctcgaattcttcttaatggtgcttctcatccctgagcccgagaagcagcggacgccccaggacaatcaactgatctacgtcatcctgaccatcctcacgatcatcggcctgatcgcagccaacgaaatgggcctgatcgaaaagaccaaaaccgacttcggcttttatcaggtgaagaccgagactaccatcctcgacgttgacctgcgccccgcgtccgcctggactctttacgccgtcgctaccactattctcaccccgatgctgcgccacaccatcgaaaacaccagcgccaacctgtctctcgcggcaatagccaatcaagccgctgtcctgatggggctaggcaagggctggcccctgcaccgcatggatctgggcgtgcccctgctggccatggggtgctatagccaggtcaatcctacgacgctgaccgcctccctggtcatgttgctagttcactatgccatcattggaccggggctgcaggccaaagcgacccgagaggcccagaagagaacggccgccggcatcatgaagaacccaaccgtcgacgggatcaccgttatcgacctcgagcccatcagctacgacccgaagttcgagaagcagctgggccaagtgatgttgttagtcctgtgcgccgggcagctgctactgatgaggactacgtgggcgttctgcgaggtattgactctcgctaccggacctatactgactctgtgggagggaaacccgggtcgcttctggaacaccaccattgccgtgtcaaccgccaacatctttcggggaagctatttagctggggcgggcctggccttctccttaatcaagaacgcccagacgcctcggagagggacgggcaccaccggggagacactcggcgaaaaatggaagcgccagctgaactctctagaccgaaaggagttcgaggagtacaagcggtccggcatcctcgaagttgacaggaccgaagccaagagcgccttgaaggacgggagcaagataaagcacgcggtaagccgcgggtccagcaagatccggtggatcgtggaacgcgggatggtcaagcccaagggcaaggtggtggacctggggtgcggccgcggcgggtggagttactatatggctacgcttaagaacgtcactgaggtaaaggggtacacgaagggtggccctgggcacgaggagccaatccccatggccacctacggctggaatctggtgaagctgcactccggtgtcgacgttttctacaagcccacggagcaagtggacacactcctgtgcgacataggggagtcatccagcaacccgacgatcgaagaggggcgtaccctgagggtcttaaaaatggtggagccctggctgtccagcaaacccgagttctgtatcaaggtattgaacccatacatgccgacggtcatcgaagagcttgagaagctccagcggaagcatggaggcaacctcgtgcgctgccccctgtccagaaatagcacccatgagatgtactgggtctccggcgcaagcgggaacatcgtttcatcggtcaataccacgtcaaaaatgctcctgaaccgcttcacgaccaggcaccgcaagcccacctatgagaaagacgttgacctgggcgctggcactcgcagcgtgtcgaccgagacagaaaaacccgacatgaccatcatcggccgcaggctacagcgcctgcaggaagagcacaaggagacttggcactacgaccaagaaaacccctaccggacgtgggcctaccacgggagctacgaggccccgagtaccggcagcgcatccagcatggtgaacggggtcgtcaagctgttaactaagccatgggacgtgatcccgatggtcactcaattggcaatgacggacaccacgccctttggtcaacagcgtgtgttcaaggagaaggttgatactcggacgcctcagcccaaacccggtacccgcatggtcatgaccacaacggcaaattggttgtgggccctcctagggaagaagaagaacccgcggttgtgtacccgcgaggagtttatcagcaaggtccggtccaacgccgcgatcggggccgtgttccaggaggagcaggggtggacaagcgcgtcagaggccgtcaacgacagccgcttctgggagctcgtggataaggagcgagcactgcaccaggaaggcaagtgcgagtcatgcgtgtataatatgatgggcaagagagagaagaaactgggggagttcggcagagctaaggggagccgggcgatctggtatatgtggctcggggcgcgattcctggaatttgaagccctggggttcctcaacgaagaccattggttcggccgggaaaactcctggtccggcgtcgagggggagggtctacatcgccttgggtacatcctcgaggagatcgataagaaggacggtgacctcatgtatgccgacgacactgccggatgggacacgcggatcaccgaggatgacttgcagaatgaagagttaatcaccgagcagatggcaccgcaccataagatactggccaaggccattttcaagttgacctatcagaacaaggtggtaaaggtcctccgccccaccccccggggggccgtcatggacatcatctcccgcaaagaccagcgtggttctggtcaggtaggcacgtacggtcttaataccttcaccaacatggaagtccagctgatccgccagatggaagccgagggcgtgatcacccaagacgacatgcagaaccccaagggcctcaaggagagggttgaaaagtggttacgcgagtgcggggtcgaccgactaaagcgaatggcgatctccggggatgactgcgttgtgaaaccactcgacgaacggttcgggacgagcctgttgttcctcaacgatatgggcaaggtcaggaaggacatcccccagtgggagccttccaagggttggaagaactggcaggaggtgcccttctgcagccaccacttccacaagatatttatgaaggacggccggtcccttgtggtaccctgtcgcaaccaggacgaactgataggccgagcacgcatcagccagggtgccggctggtccttgagggaaaccgcttgtctgggtaaggcgtatgcgcagatgtggtcgctcatgtacttccaccggcgcgacctaagactggccagcatggccatctgctccgccgttcccaccgagtggttccctacgtctcgcacgacgtggtccatccatgcccaccaccagtggatgaccaccgaggatatgctgaaggtgtggaaccgggtctggatcgaggacaacccgaatatgattgacaaaactccagtgcatagctgggaggacatcccctacctcggcaagcgcgaggacctgtggtgcggcagtcttatcgggctcagctcccgcgctacctgggccaagaatatccacaccgccatcacccaagtgcgcaaccttatcggcaaggaagagtacgtagactatatgcctgttatgaagcgttactctgccccatctgagagtgagggggtgctgtga

SEQ ID NO: 26253 - RNA, 9867 nt, synthetic construct
  misc_feature 1..9867: note = derived and/or modified CDS sequence (opt11) from DENV-4__FJ882596__SS-prME
  source 1..9867: mol_type = other RNA
tcgaccataaccctactatgcctaatacccacagtgatggctttccacctcagcacccgagacggggaacctttaatgatcgtcgcaaaacacgaacgcggacgcccgttactattcaaaactacagaaggcattaacaaatgcaccctgatagccatggacctcggcgaaatgtgtgaggataccgttacatacaaatgtcccctcctagtaaatactgagcctgaagacatagattgttggtgcaatcttactagcacctgggttatgtatgggacatgcactcaatccggagagcgcagaagggaaaaacgctcagtcgccctaacaccccacagtggcatgggcctcgaaacacgggctgaaacatggatgtcaagtgaaggggcgtggaaacatgcccaacgagtagaatcgtggatactaaggaatccgggattcgccctgctagccggtttcatggcatacatgatcggacaaaccggcatccagagaacagtcttcttcgtactaatgatgctagtcgctccaagctacggcatgagatgcgttggagtcggcaaccgagactttgttgaaggagtatcaggcggggcgtgggttgacctggtcctcgaacacggaggatgcgtgacgacgatggctcagggtaaacccacactcgattttgaactgacaaaaacgaccgcaaaggaagtagcgctactccgcacatactgcatcgaagcgagtatatccaatataacgactgcgacgcggtgccctacacagggtgagccatacctaaaagaggagcaggaccaacaatacatctgccgaagagacgtcgtcgacagaggatggggcaacgggtgtggtctattcggtaaagggggtgtggtaacatgcgcgaaattcagctgcagcggcaagataacggggaatctcgtacagattgaaaacttagagtacaccgtagttgtgacggtacacaacggggacacccacgcagtaggaaacgacacgtccaatcacggagtaacagccacgataacacctcgatcacccagcgtggaggtcaaactgcctgactacggggaactcacgttagattgcgaaccccggagcggcatcgacttcaacgaaatgattttgatgaaaatgaagaaaaagacttggctagtccacaaacaatggttcctagatctaccgctcccatggacagctggagcagacacctccgaagtccattggaattacaaagagaggatggtaaccttcaaggtaccgcacgcaaagcgccaagacgtgacagtcctggggagccaagaaggagcaatgcatagcgcactggccggcgcaaccgaggtagattcgggcgacggaaaccacatgttcgcagggcacctgaagtgcaaagtacgaatggaaaagctccggataaaaggaatgagctacaccatgtgcagcggtaagttcagtatagacaaagaaatggcagaaacccagcacggcacgacagtagtgaaggtcaaatacgagggcgcaggcgcaccttgcaaagtacccatagaaatcagagacgttaacaaagagaaggtagtgggccgggtgatctcgtcaacgccgcttgcagaaaataccaattccgtcaccaacatagaactagaaccaccgtttggggacagctatattgtgatcggagtgggtaacagtgccctcacactccactggtttaggaagggctcgagtatcgggaaaatgttcgaaagtacgtacagaggagcgaagagaatggcaatacttggagaaactgcctgggatttcggaagcgtgggtgggctattcacaagccttggcaaagccgtccaccaggtgtttgggagtgtatacacaaccatgttcggaggcgtcagttggatgatacggatactgatcggtttcctggtactgtggattgggacaaattccagaaacacatccatggccatgacatgtatcgcagtaggagggatcacgttattcctcggcttcaccgtacaagcagacatgggctgcgtggtctcctggagcgggcgggagcttaaatgcgggtccggcatctttgtagtagataatgtccatacgtggaccgagcaatacaagtttcaaccagagagtcccgccagactggcttccgcgatcctgaatgcccacaaagacggcgtgtgtggaatcaggagcactacacggctcgagaacgtcatgtggaagcaaataacaaatgagctcaactacgtcctatgggaaggcggccatgacctaacagtcgtcgcgggagacgtgagaggagtgctaacgaaagggaaacgagcgctaacacccccagtgtctgatctcaagtactcatggaaaacctggggcaaagccaaaatcttcacccccgaagcccggaatagcacgtttctcatagacggccccgacacttccgaatgcccaaatgaacgaagggcgtggaacagcctagaagtggaggactacggatttggaatgttcacgaccaacatatggatgaaattccgggaagggtcttcagaagtatgcgatcacaggctgatgtctgcggctataaaagatcagaaggcagtgcacgcggacatgggctattggatagaatccagcaaaaatcagacatggcagatcgaaaaggcttccctgatcgaagtcaaaacctgcctgtggccaaaaacacacaccctttggagcaacggagtcctcgagtcacagatgctaatacctaagtcgtacgccggccctttcagccagcacaactaccgtcagggatatgcgacccagacggtcgggccatggcacctgggaaagttggaaatcgacttcggggaatgcccagggacgacagtgaccatccaagaggactgtgaccacagaggcccatcactaagaacaacaaccgcctctggaaaactcgttacccaatggtgttgcagaagctgcacaatgccacccttaagattcttaggagaagatgggtgctggtacgggatggaaatccgccctttatcagagaaggaagaaaatatggttaaaagccaagtcgccgccggacagggcaccagcgagaccttctccatgggactattatgtctcaccttgttcgtagaggaatgcctacgacgcagggtaacgcgaaaacacatgattctagccgtagttatcacactatgcgcaataattcttggcggattgacttggatggacttactccgggctctcatcatgttaggagacacgatgagtggccgaatcggagggcagacacaccttgctataatggctgttttcaaaatgtctccaggctacgtgttgggagtatttttgcgtaaactcaccagccgagagaccgccctcatggtcataggcatggcgatgaccaccacgctctcaataccacacgacctcatggagcttattgacggaatctctttgggcctcatactcctcaagatagtgacacaattcgacaacacacaggtagggaccctggctctctcgctgacattcatcagaagcaccatgagtctcgtcatggcgtggcgaacaatcatggctgtactgttcgtagtaaccctcatccctctatgccgtacgtcctgcttgcaaaaacagagtcactgggttgaaatcactgcgctcatacttggggcccaagcgctgcccgtgtaccttatgacactgatgaagggagcgagtcgtcgatcctggccactcaacgaagggatcatggccgtcggactcgtatcactactgggctcagcgctgttaaagaacgacgtacccttagcaggcccaatggtggctggaggcctgctattggcagcctacgtcatgagcggtagtagtgcggacctgagtctcgaaaaggctgcgaatgtgcagtgggacgaaatggccgacattacagggtcgagtccaatcatagaagtaaaacaagacgaggacgggagcttcagcatccgagacgtagaagaaaccaatatgataacactcctagtcaaactagcgctaatcactgtgtccggcttgtacccactggctatcccagtcacgatgactttgtggtatatgtggcaggtaaaaacgcaaaggtctggcgcattatgggatgtaccaagccctgccgccacccagaaagccgcgctctcagaaggagtctaccgaataatgcaaaggggactatttggtaagactcaagtaggcgtagggatacacatggagggagtgttccacactatgtggcatgtaacgaggggcagtgtcatctgtcatgaaaccggccggctcgaaccatcttgggcagacgtacgaaatgacatgatctcatacggtggaggatggcgcctaggggacaaatgggataaagaggaagacgtacaagtcctggcaattgaaccggggaaaaaccccaaacacgttcaaaccaagcccggactcttcaaaacacttacgggggaaatcggagcagtaaccctagatttcaaaccgggtacgagcgggagtccaataattaacagaaaaggaaaagtaatagggctatacggaaacggagtggtcacgaaatcaggcgactatgtgtcagccataacacaggccgagaggatcggagagccagattacgaagtagacgaggacatattcagaaagaagcgactaacaataatggacttgcaccccggagccggtaaaacgaaacgaatcctccccagcatcgtgcgtgaagccctaaaaaggcgcttgcgtaccctcatactagcccccacacgagtagtagccgcggaaatggaagaagccctgcgaggactcccaatccgttatcagacacccgccgtgaaaagcgaacacactggacgagaaatcgtcgacctaatgtgtcatgcgacatttaccacgcgattactcagcagtaccagggtaccaaactacaacctaatcgttatggatgaagctcacttcaccgacccttcctcggtcgcggctcgaggatatatctctacccgggtggagatgggggaagcggcagcgatatttatgaccgcgaccccgcctggagcgacggacccgttcccacagtccaactcgccaatcgaggacattgaacgagaaatccccgaacgaagctggaacacggggttcgattggataacggactatcagggcaagacagtttggttcgtgccaagcatcaaagccgggaatgacatcgcaaactgcctccgcaaatcagggaagaaagtaatccagctatcgcgcaaaacattcgacaccgagtaccctaaaacaaagctgacagattgggacttcgtcgtcaccacggacatcagtgagatgggcgccaacttcagagcgggccgagttatagacccccgccgctgcctcaaaccggtgatcctaaccgatgggccagaaagggtcatactggccggaccgattcccgtgacccccgcgagcgcagcccagaggcgcggacggatcggtaggaaccctgcacaagaagacgaccaatatgtgtttagcggagaccccctcaagaacgacgaagatcacgcacactggactgaagccaaaatgttactagacaacatatacacacctgagggcataattccaacactcttcggccccgaacgagaaaagacacaggcgatcgacggggagtttcggttacgaggcgaacaaagaaagacgtttgtagagctcatgcggaggggcgatctgccggtatggctaagctataaggtggcatcagccgggatatcctacaaagatagggagtggtgcttcacaggggaacggaacaatcaaatcctggaggaaaatatggaagtagaaatctggacacgggaaggagaaaagaagaaactacgaccccggtggctagacgcgcgcgtgtacgcagacccgatggccctaaaagacttcaaagagttcgcaagcggaaggaaatctataaccctggatattctcacagaaatagccagcttaccaacgtatctatcttcgcgcgccaaactagctttagacaacatagtaatgctacacaccaccgaacgaggaggccgagcctaccagcacgcgctcaacgagctacccgagtcactcgagacactaatgctggtagcactcctcggcgcaatgaccgcgggcattttcctattcttcatgcaagggaagggcataggaaaactctccatgggtctcatcaccatagccgtcgcctcgggcctactctgggtcgccgaaatccagccacaatggatcgcggcgtcgatcatactagaatttttcttaatggtcctactaatacctgaacccgaaaaacagcggacgccacaagacaaccaattaatctatgtcatactaacgatattaactataatcggcctaattgccgctaatgaaatggggctcatagagaaaaccaaaacggactttggattctaccaggtaaagacagagacaacaatactggacgtcgacctccggcccgccagtgcctggacactctacgcggtggcaaccacgatcctaactcccatgttgaggcacaccatagaaaacacgagcgcaaatttgagtctggcagcaatcgcgaaccaagcagcggttctaatgggtctcggcaaggggtggcccctgcatcgcatggatttgggcgtgccgctcttggctatgggttgctactctcaggtcaatcccacaaccctaaccgcaagtctcgtcatgctgctggtacactacgccatcataggacccggcctgcaagctaaagcgacacgagaagctcagaagagaaccgcagcaggcataatgaagaacccgaccgtcgacggaatcacggtcatagatttggagccgatcagctacgaccctaagttcgaaaagcaactcggacaagtaatgcttctagtcctgtgcgccggccagctcctcctgatgagaaccacctgggcattttgtgaggtactcaccctagctacaggcccaatactcacgctatgggaagggaatcctggcaggttctggaacacaacaatagcagtgagcacagcaaacatcttccgaggatcatacctcgccggcgcaggactggcgttctccctcatcaaaaacgcccagacacctaggagaggcacagggaccacaggggaaaccctcggagaaaaatggaagcggcagctcaacagcctagatcgaaaagagttcgaagagtataaacgatccggcatcttagaggtggacaggacagaagcaaagtccgctctcaaagatggatcgaaaataaaacacgcagtctcccgaggttccagtaaaatccgatggatagtcgagcgaggcatggtgaaacccaaaggcaaagtagtggacctcggctgcggacgaggtggatggagctactacatggccacgctgaagaacgtaacagaggtaaaaggctacacaaaagggggacccggccacgaagaacccataccgatggcaacctatggatggaacctagttaagctgcactctggcgttgacgtcttctataagccaacagagcaagtagacacgctcctctgcgacataggcgaaagctcgagcaaccccacaatcgaagaggggcggactcttcgagtgctcaagatggtagaaccatggctgagctccaagcccgagttctgtataaaagtacttaacccatacatgcccacagttatagaggaactagagaaacttcaaaggaaacacggagggaacttggtacggtgcccccttagccggaacagcacacacgaaatgtactgggtgtcaggggcctccggcaatatagtcagctccgtaaacaccacatcaaaaatgctactgaaccggttcaccacgcgtcaccgaaagccgacttatgaaaaagacgtagacctgggtgcgggaacacgatcagtgagtactgaaacagaaaaaccagacatgaccatcataggacgacgccttcagagactacaagaggaacacaaagagacatggcactacgaccaagagaacccatatcgaacctgggcataccacggctcttacgaagcaccctcgaccgggtccgcgagctcgatggtcaacggcgtcgtgaaactactcacgaaaccgtgggatgtcatcccgatggtaacacaactagccatgaccgacacgacaccctttggccaacagcgggtgttcaaagaaaaagtagacaccaggacaccccaacctaagcccggaaccaggatggtaatgacaaccaccgcaaactggctgtgggccctcctaggcaagaagaaaaacccaaggctctgcacgcgcgaagagtttataagcaaagttcgatcgaacgccgcaatcggcgcagtcttccaggaggagcaaggttggacgtcagctagcgaggcggtcaatgactcacgcttttgggagctggtcgacaaggagagagcgttgcaccaagaagggaaatgcgaatcctgcgtatacaatatgatgggcaagagagagaagaaactgggagagtttgggcgggccaagggctcgagagcgatctggtacatgtggcttggagcacgcttcctcgaatttgaagctctaggctttttaaacgaagatcactggttcgggcgcgagaatagctggtcgggcgtcgaaggagaaggactacacaggctgggttatatactagaagaaatcgataagaaagatggcgacctcatgtacgcagacgatacggcaggctgggacactagaatcaccgaagacgacctccaaaacgaggaattaatcactgaacaaatggcgccacaccacaaaatactggcaaaggcgattttcaaactcacctaccagaacaaggttgtcaaggttttacgccccacaccccggggagcagtgatggacataatcagcaggaaagatcagcggggaagtggacaggtagggacctacggcctaaacaccttcaccaatatggaggtgcagttaattagacagatggaggcagaaggagtcattacccaggacgacatgcaaaacccaaaaggactcaaggaaagagtagaaaaatggctccgcgaatgtggagtcgataggttgaaaagaatggctataagcggggacgactgcgtagtcaaaccgctggatgaaaggtttgggacgagcctcctatttctgaacgacatgggtaaggtcagaaaggacataccacagtgggaaccatcgaagggatggaaaaactggcaggaagtcccattttgtagccatcacttccacaaaatctttatgaaagacggccgaagtctcgtagtaccctgcagaaaccaggatgagctaatcgggagagcacgaataagccaaggcgcaggatggagccttagggaaacagcctgcctcggtaaggcctacgcccagatgtggagcctaatgtacttccatcgtcgcgacctcagactagcgtcgatggcaatctgcagcgcggtcccgaccgaatggttccccacctcccgtaccacctggtccatacacgcccatcaccaatggatgaccacggaagatatgctcaaagtgtggaaccgtgtctggattgaagacaatcccaacatgatcgacaaaacgcctgttcactcatgggaagacatcccctatctaggtaagcgcgaggacctctggtgcggatcattgatcgggctctcctcccgagcaacctgggccaagaacatacacaccgcaatcacgcaggtccgcaacctcatcggtaaagaagagtatgtagactacatgcccgtaatgaagcggtatagtgctccttcagaatcggaaggggtgctatga

SEQ ID NO: 26254 - RNA, 9867 nt, synthetic construct
  misc_feature 1..9867: note = derived and/or modified CDS sequence (opt11) from DENV-4__FJ850059__SS-prME
  source 1..9867: mol_type = other RNA
tcaacgatcacactactatgtttaattcccacagtaatggcattccacctctcaacccgggacggcgaacctttaatgatcgtggcgaaacacgaacgcggaagacctctgctattcaaaacgacagaagggatcaacaaatgtaccctgatagccatggacctcggagaaatgtgcgaagacacggtgacctacaaatgccccctcctagtgaacacggaaccggaagacatcgactgctggtgtaatctcaccagtacatgggttatgtatgggacctgcacacagagtggagaaagacgacgcgaaaaacgtagtgttgcattaacaccgcactcagggatgggactggaaacgagggccgaaacgtggatgtccagcgaaggcgcatggaaacacgcccaacgcgtagagtcctggatcttaagaaacccaggattcgcactcctagccggattcatggcgtacatgatcggtcagacgggaatccaaagaacggtgtttttcgtactcatgatgttagtagctccgtcatacgggatgagatgtgtgggagtggggaatcgggacttcgtagagggggttagcgggggcgtctgggttgacctagtcttagaacacggcggatgcgtgacaacaatggcacaaggcaaacctactttggacttcgagctaaccaagacaaccgcaaaagaggtagcgctcctgagaacatattgcatcgaggcatcaatcagtaacatcaccacagcaacgcggtgccccacacaaggtgaaccgtatttaaaggaggaacaagaccagcagtacatatgtcgaagggacgtggtagaccgtggatggggaaacggatgcggtctgtttggaaaaggaggcgtggttacatgcgctaaattcagctgcagcgggaaaataacaggcaacctagtacaaatcgaaaatctcgaatacacggtcgtggtgacagtgcacaatggagacacccacgccgtgggtaacgacacctccaaccacggggtgacggcaacaattaccccaagatctccgagcgtagaagtaaaactaccggattacggagaactaacactggactgcgagccccggagcggaatagatttcaacgagatgatactgatgaaaatgaagaagaaaacgtggctggtgcacaaacaatggttcttggacctacccctcccgtggacagcgggcgccgacacatcggaagtccactggaactacaaagagaggatggtaacgtttaaagtgccccacgctaaacggcaagacgtaaccgtcctaggttcgcaagaaggtgccatgcacagcgcgctcgcaggagcaaccgaagtggactcaggagacggaaaccatatgttcgccggacatctaaagtgtaaagttagaatggagaagctcaggatcaaggggatgtcttatacaatgtgcagtgggaagttctcaatcgacaaagagatggctgagacacaacacgggacgactgtggtcaaagtaaaatacgaaggagccggtgcgccctgtaaagtaccgatagaaatcagagatgtgaacaaagagaaagtagtgggacgagtaatctcgtcaacccctcttgccgagaacacaaactcagtaaccaacatcgagctagagccaccctttggcgacagttacatcgtcatcggggtcgggaatagcgcattgacactccattggtttcgaaaggggagctcaataggcaagatgttcgaatcaacgtacaggggcgccaagcgtatggcgattctgggagagacagcatgggacttcggaagcgtaggaggactcttcacatcactaggcaaggccgtccaccaggtcttcgggtcggtgtacacaaccatgttcgggggagtaagctggatgatcaggatactaatcgggttcttggtattgtggatcggaacaaattcccgtaacacaagcatggccatgacctgtattgcagttggtgggatcaccctattcctgggctttaccgtgcaggcggacatggggtgcgtagtctcttggagtggcagggagttgaaatgtggctccggtatcttcgtcgtagacaacgtccacacctggacagagcagtacaaattccaaccggagtcacccgctcgactagcgtctgcgatcctaatcgcccacaaagacggagtgtgcggaatcaggtccacaacgagacttgaaaacgtcatgtggaagcagatcaccaacgagttaaactacgtactgtgggaagggggacatgatttgaccgtagtagccggcgatgccaagggtgttctgacaaaaggaaaacgggcactaacaccaccagtcagcgacctcaagtacagctggaaaacttggggaaaagcgaaaatatttacacccgaggccaggaacagcacattcctgatcgatggaccagacactagcgaatgcccaaacgagcgccgagcttggaacagcctcgaagtcgaggattacggattcggtatgttcacgacaaacatctggatgaaattcagggagggaagtagcgaagtatgcgaccataggctcatgagcgcggccataaaagaccaaaaagcggtacacgcggacatgggatattggattgagagctcaaagaaccagacgtggcaaattgaaaaggcttcgctaatagaagtgaaaacatgtctctggccaaaaacacatacgctgtggtcgaacggcgtcctcgaatcacaaatgctcatcccaaagagttatgcgggcccattctcacagcacaactatcggcaaggctatgcaacacagacagtcggtccctggcacttaggcaagctcgaaatcgatttcggcgagtgccccgggacaaccgtcacgatacaggaggactgtgatcaccggggcccatcactcagaacgactacagcctcgggcaagctagtaacccaatggtgctgtagaagctgcaccatgccacccttacggttcctaggagaggacgggtgctggtatggcatggaaataagacccctgagtgagaaggaagaaaacatggtcaaaagccaagtcaccgcggggcagggaaccagcgaaactttttcgatgggcttactatgcctcacgctattcgtagaggaatgtctaagacgaagggttacacgtaaacacatgatccttgcggtcgtgataaccctatgcgcgataatactgggcggactaacttggatggacctattgcgagcgctaatcatgctgggagacacgatgtctggaaggatcgggggacaaacccatctcgcaattatggcagtcttcaagatgtcgccggggtatgtcctaggcgtatttctccggaaactgacgagtagagagacagcactaatggtcatcgggatggccatgacaacgacgctaagcatcccccacgacctcatggaactcatcgacggcatctctctgggattaatcctattgaagatagttacccaattcgataacacccaagtcgggacgctagcgctcagcctcacatttatccgaagcacgatgtcattagtcatggcctggagaaccataatggccgtcctattcgtggtaacactcataccactatgcagaacgagctgcctacagaaacaaagccactgggtagaaatcacagcgctgatcttgggcgcacaagccttacccgtatacctgatgacactaatgaaaggagctagcagaagatcctggccattaaacgagggaataatggcggtgggcctcgtgagcctacttggtagtgcccttctcaaaaatgacgttcccctagccgggccaatggtagcagggggcctccttctcgcggcatacgtaatgtcggggtcctcggcggacctgagtctagaaaaggctgcaaatgtccaatgggacgagatggcggacataacagggagcagcccgatcatcgaggtcaaacaggacgaggatgggagcttctcaatacgcgacgtggaagaaaccaacatgataacactgctagtcaaactggccttaattaccgtgagtggactctacccactagccataccagtcacaatgacactgtggtacatgtggcaagtaaaaactcagcggagcggagcgctatgggacgtgcccagtcctgccgctacccagaaagccgcactttccgagggtgtatatcgaatcatgcagcgcggactcttcgggaagacacaggttggtgtaggaatacacatggaaggagtattccacaccatgtggcacgtgacgcgaggctcggtgatatgtcatgaaacgggccgcttagaaccgtcctgggcagacgtgcgcaacgacatgatctcttacggaggaggctggcgactgggtgacaaatgggataaggaagaggacgtgcaggtactagcaatcgagcccggtaaaaacccaaagcacgtccagacgaagccaggcttgttcaaaacacttacgggagaaattggcgccgtcacgctcgacttcaaaccaggaacatcgggaagcccgataataaatcgaaaaggcaaagtcatcggtctgtatggcaacggggtggtgacgaaatccggagactacgtaagtgcgatcacccaggctgaacgaatcggagagcctgactatgaagtagacgaggacattttccgtaagaaacgcctcacgataatggatctacaccccggcgcgggcaagacgaaaagaatactaccaagcatagttcgcgaagcactaaaaagacgactgcgaaccctcatactcgcgccgacccgtgtggtcgcggctgagatggaggaagccctacgcggtctcccaataagataccaaacaccagcagtgaaaagcgagcacactggccgagagatcgtagatttaatgtgccatgctactttcaccactcgcttactatcctcgacacgagtcccaaattataacttgatagtgatggatgaagcgcacttcacagacccaagctcggtcgcggcgcgcgggtacatctctaccagggtagaaatgggagaggcagcagcaatcttcatgacagccacacctccgggggcgacagacccgttccctcaatccaactctccaatagaagacatcgaaagagaaatacccgaacgcagttggaacacgggtttcgattggattacagactaccagggaaagaccgtctggtttgtaccgagcataaaagctggcaacgacatagcgaactgcttaaggaaatccggaaagaaagtaattcaactcagccgtaaaacgttcgatacggaataccccaaaaccaaactgaccgattgggacttcgtcgtcacaacggacatcagtgagatgggcgccaacttcagagccggccgcgttatagacccaagaaggtgcttaaagccggtcatcctcacagatggacccgagcgagtgatactggccggtccaatcccggtaacaccagcaagcgcagcacagcgaagagggaggattggccgaaaccccgcacaagaagacgatcaatacgtgttcagcggggacccgctaaagaacgatgaagaccatgcccactggacagaggccaagatgttgctggacaacatttacacgccagagggcataatcccaactctattcgggccggagcgcgagaaaactcaggctattgacggagagttcagattaaggggtgagcaaagaaaaacgtttgtggagctaatgaggcgcggtgacctaccagtctggctttcatataaagtagcatcagccggcatttcatacaaagaccgagagtggtgcttcacaggggagcgaaacaaccaaatactggaggaaaacatggaggttgagatctggaccagagaaggggagaaaaagaaacttagaccacgatggctagacgcacgcgtgtacgctgatcctatggcgctaaaagatttcaaagagttcgcgagtggaaggaaaagtataactctcgacatactcaccgagattgcttccctcccgacgtacctgtccagtcgagcgaaactagcactagacaatatagtaatgcttcatacgacagagcgaggcggccgcgcgtaccaacacgcgttgaatgaactaccggagagcctagagacactgatgctcgtggcgctgctgggagcgatgactgcaggtattttcctgttcttcatgcaagggaaaggaatcggcaagctctcaatgggattaataacaattgccgtcgcatctggattattatgggtggcggagatccagcctcaatggattgctgcctcaataatcttagagttctttctcatggtcttgctcatacccgaaccagagaaacaacgaacaccacaggacaaccagcttatctacgttatactcacgatcttgacgatcatcggcctaattgcagcgaatgagatggggctaattgagaagacaaaaaccgacttcgggttctatcaagtcaagacggagacaactatcttggacgtagatctacggccggcgtcagcatggacgctctacgccgtagcaacaactatactgactccaatgctaaggcacactattgaaaacacaagcgcgaacctaagcctagcagccatcgcgaatcaggcagccgtattaatggggctaggaaagggatggccactacataggatggatttgggggtacctctactggccatgggctgctactcccaagttaatcctactacactgacggcatcgctggtgatgctcctagtacactatgctattatcggcccaggcctgcaggctaaggcgacccgggaggcacaaaagagaaccgccgcgggaataatgaagaaccccaccgtggacggcatcacagtgatcgatctggaacccataagctatgaccctaaattcgagaagcaactcggccaagtcatgctactcgtgctctgcgccggccaactcctgctgatgaggaccacatgggccttttgcgaagtgttaacgctcgctaccggaccaatactcaccctgtgggaaggaaacccaggaagattttggaatacgaccatcgccgtaagcacagctaacatcttccgaggaagctacttagcaggggcgggactagctttttcactcataaagaacgcgcaaactccccgaaggggtacaggcacgacaggtgagactcttggagaaaaatggaaacggcaactgaactcgctcgacagaaaagaatttgaagaatacaagagaagcggaatactcgaagtagaccggacagaagcgaaaagcgccctcaaagacggcagcaaaattaaacacgcagtgtctcgtgggtcctcaaaaatacggtggatcgttgaaagaggcatggttaaacccaaaggaaaggtcgtagacttggggtgtgggcggggaggatggagctactatatggcaaccctcaagaacgtgacggaagtaaaaggatacacaaaagggggccccggccacgaagaacctatcccaatggcaacatacggatggaaccttgttaaactacatagcggagtcgacgttttctacagacccaccgaacaagtggacaccctgctttgtgacataggggagagctcgagcaatcctacgatagaagagggacggacgctcagagtactgaaaatggttgaaccgtggctgtccagcaagcccgagttctgcataaaagtactaaacccgtacatgccgacggtaatagaagaattggaaaagctccagagaaagcacggtgggaacctcgtacgatgtccactatcgcggaactccacacacgaaatgtattgggtgtctggtgcaagtggtaatatcgtaagctcagtgaacacgacatcaaaaatgctacttaatcgattcaccacacgacatcgtaaaccaacctatgagaaggatgtagacctaggtgcgggcacacggagcgtcagcacagaaacggagaagcccgatatgacaataataggtcgcaggctccaaaggctacaagaggaacataaagaaacctggcactacgaccaggagaacccgtacagaacgtgggcgtaccacgggagctatgaggccccgtctaccggctccgcaagttcgatggtaaacggagtggtgaaactccttacgaaaccgtgggatgtcataccaatggttactcaactagccatgaccgacacaacaccattcgggcaacagcgggtcttcaaagagaaagtggacacccgtacgccccagccaaaacctgggactcgcatggtcatgactactactgcaaactggctttgggccctattaggtaagaaaaagaatccgcgtttatgcacccgcgaggagttcataagtaaggtccgatctaacgcagcaatcggtgcagtattccaagaagaacagggatggacaagtgcctcagaagccgttaacgacagccggttttgggaattagtcgacaaagagcgagcattgcaccaagaaggcaaatgtgaatcatgtgtgtacaacatgatgggaaaacgcgagaagaaactcggcgagttcggacgcgcgaagggaagcagagcaatctggtacatgtggctcggcgctagattcctggagttcgaggcattaggattcctaaatgaggaccactggtttggtcgcgaaaactcttggtccggcgtggaaggggaggggctgcacagactaggctatattttagaagagatcgacaagaaagacggcgacctaatgtacgcggacgacacggcaggctgggacacccgcatcacagaagacgacctgcagaatgaggagctaataacggaacagatggctccccaccacaagatcctggctaaagcaattttcaaactaacctaccaaaacaaagtcgtcaaggtcctacgacccacgccccgcggggcggtgatggacattatatcgcggaaagaccagcggggaagcggtcaggtggggacctacggattgaacaccttcacaaacatggaagttcaactgatccggcaaatggaggctgaaggagttattactcaagatgatatgcaaaatcccaaaggtctcaaagaacgtgtcgagaagtggctcagggaatgtggggtcgatagactgaagaggatggccatatcgggtgacgactgcgttgtaaaacccctggacgaacgtttcggcaccagcctcctatttttaaatgatatgggcaaagtacgtaaagacataccacaatgggaaccgagcaagggctggaagaactggcaagaagttccgttctgcagccatcacttccataaaatatttatgaaggacggcaggtccttagtcgtaccgtgtcggaaccaggatgaactgatcggtcgcgcccgcatcagccagggggcgggatggtcactgcgggaaactgcgtgcctgggtaaggcgtatgcgcaaatgtggagcttgatgtacttccaccgcagagacttaagactcgcatcaatggccatctgtagcgcggtcccaaccgagtggtttccaacctcccggaccacttggtcaatacacgcccaccaccagtggatgacaactgaagacatgctgaaagtatggaatcgggtgtggatagaagacaatcccaacatgatagacaaaaccccagtccactcctgggaagatatcccgtacctagggaaaagagaggacctttggtgtggaagcctaataggactatcgtcacgcgcgacatgggccaagaacatccacacagcaataacacaggtgcgaaacctgataggtaaagaagagtatgttgactatatgcccgtcatgaaaagatacagcgcgcccagtgaaagtgaaggcgtactataa

SEQ ID NO: 26255 - RNA, 9867 nt, synthetic construct
  misc_feature 1..9867: note = derived and/or modified CDS sequence (opt11) from DENV-4__FJ882598__SS-prME
  source 1..9867: mol_type = other RNA
tcgacgatcaccctgctctgcctgatacccaccgcgatggctttccacctgtccacccgcgacggtgagcccctcatgatcgtggcgaagcacgagcgggggcgccccctgctgtttaagaccacggagggcattaacaagtgcacgttgatcgctatggacctcggtgagatgtgcgaggacaccgtaacctacaagtgccccctgctcgtgaacaccgagcccgaggacatagactgctggtgcaacctgaccagcacctgggtcatgtacgggacctgtacccagtccggggagaggcgccgggagaagcgcagcgtcgccctaacgccgcactccggcatggggctcgagaccagggcggagacctggatgtcgtccgagggggcctggaagcacgcgcaacgcgttgagagctggattttacggaaccccggctttgcgttgctcgctgggttcatggcttacatgattggtcagaccgggatacagcgcacggtgttcttcgttctgatgatgctggtggcgccctcctatggcatgaggtgcgtaggcgtcgggaaccgcgacttcgtggagggcgtgagcgggggcgcgtgggttgacctcgtgctggaacatggcgggtgcgtgacgaccatggcccaggggaagcccacgctggatttcgagctgacgaagaccaccgccaaggaggtcgcccttctgcggacgtactgcatcgaggcgtccataagcaacatcaccactgccacccgctgcccgacgcagggcgagccctacctcaaggaggagcaggaccagcagtacatctgccggcgcgacgtggtggaccggggctggggtaacggctgcgggctgttcgggaagggcggggtggtgacgtgcgcaaagttctcctgcagcgggaagatcaccggcaatctcgtgcagatcgagaacctcgagtacaccgtcgtggtgaccgtccacaacggtgatacgcacgccgtgggcaacgacaccagcaaccacggtgtcaccgcaaccatcactccccgcagcccctccgtggaagtcaagctgccggactatggcgagctgaccctcgactgcgagccccggagtgggatagacttcaacgagatgatactgatgaagatgaagaagaagacctggttggtacacaagcagtggttcctcgacctgcccctgccctggaccgcgggcgccgacacctccgaggtacactggaattacaaggagcgcatggtgacgttcaaggtcccccacgccaagcggcaggacgtgaccgtgctcggaagccaggagggcgccatgcactcggccctcgcgggcgccactgaggtagactccggggacggcaaccacatgtttgccgggcacttaaagtgcaaggtgcgcatggagaagctccgcatcaagggcatgagttacaccatgtgctccgggaagttcagcatcgacaaggaaatggcagagacgcagcacgggaccaccgtggtcaaagtgaagtacgaaggcgccggggcgccctgcaaggtgcccatcgagatccgggacgtcaacaaggagaaggtagtggggagggtcatttccagcacccccttggccgagaacaccaactccgtgaccaacatagagctggagccgccctttggggactcctatatcgtgatcggcgtcggtaacagtgccctcaccctccactggttccgtaaggggagctccatcggcaagatgttcgagagcacctatcgcggggccaagcggatggcgatcttaggggaaacggcctgggatttcggctcagtgggaggactcttcaccagtttgggcaaggccgtgcaccaggtattcggctccgtgtacacaaccatgttcgggggcgtgagctggatgatccgcatcctgatcgggttcctcgtcctatggatcgggacgaactcccggaacacctccatggcaatgacttgcatcgcggtgggcgggattaccctgttcctaggcttcacagtgcaggcggatatgggatgcgtcgtgtcatggagtgggcgcgaactcaagtgcggcagcggcatcttcgtggtagacaacgtgcacacatggaccgagcagtacaagttccagcccgaatcgcccgcccggctggccagcgccatccttaacgcccacaaggacggcgtgtgtggcatccgctccacaacgcggctcgagaatgtcatgtggaagcagatcaccaacgagctgaactacgtgctgtgggagggcggtcacgacctcacggtggttgcgggggacgtgaagggcgtgctgaccaaggggaagcgggccttgacgccgcccgtcagcgacctcaagtactcgtggaagacctggggcaaagcgaagatcttcacccccgaggcccggaacagcaccttcctgattgatgggcccgacacgtccgagtgtccgaacgagcgccgagcctggaacagcctggaagttgaggactacggctttgggatgtttacgaccaacatttggatgaagtttcgcgagggctccagcgaggtatgcgaccaccggttaatgtccgcggccatcaaggatcaaaaggccgtccacgccgatatgggctactggatcgagagcagcaagaaccagacgtggcaaatcgagaaggcgagcctgatcgaggtgaagacgtgcctgtggcctaagacgcataccctctggtccaacggggtgctggagagccagatgctgatcccgaaaagctacgccggcccgttcagccagcacaactacaggcaggggtatgccacacagaccgtcggaccctggcacctcgggaagctggagatcgacttcggagagtgccccggcactaccgtcaccatccaggaagactgcgaccatcgggggcccagtttgcgcaccacgaccgccagcggcaagttagtgacccagtggtgctgccgctcatgcaccatgccgcctctgcggttcctgggggaggacggctgctggtacgggatggagattcgccctctttccgagaaggaggagaacatggtcaagagccaggttgctgcgggacagggcacgtccgagaccttcagcatgggactgctgtgcctcaccctgttcgttgaggaatgtctgcgccgccgggtgacgaggaagcacatgattctcgccgtggtcatcacgctgtgcgccatcatcctgggtgggctcacatggatggacctcctgcgggcgctcatcatgttgggcgacaccatgagcggccggatcggagggcagacccatctggccatcatggcggtgttcaagatgagtcccgggtacgtgctgggcgtcttcctgcggaagctgacgtcacgtgagaccgccctcatggtgatcggaatggccatgaccaccaccctgagcatcccccatgacctgatggagctcatcgacggcatctccctgggcctgatcctactgaagatcgtgacacagttcgacaacacccaggtcgggaccctggccctctccctgacgttcatccgatccacgatgagcctggtgatggcctggcgcacaatcatggcggtgctgttcgtcgtgaccctgatccccctctgccggacatcctgcctccagaagcaaagccactgggtggagatcaccgccctgatactgggcgcccaggccctacctgtctacctaatgacactgatgaagggcgcgtccaggcggagttggcccctcaacgaaggcataatggccgtggggctggtatccctgctcggcagcgcacttctgaagaacgacgtccccctcgcaggccccatggtcgccggtggcctccttctcgcggcctacgttatgtcagggtctagcgccgacctgtccctggagaaggccgccaacgtccagtgggacgagatggcggacatcaccggcagctcccccatcatcgaagtgaagcaagacgaggatgggagcttctccatccgcgacgtggaggagactaacatgatcaccctcttagtcaagttagccctcatcacagtgagcggcctatacccccttgccatcccggtgaccatgacgctctggtacatgtggcaggttaagacccagcggtccggagctctgtgggacgtgcccagccccgccgctactcaaaaggccgccctgtccgagggggtgtacaggatcatgcagcggggcctcttcggcaagacacaggtcggtgtgggaatccacatggagggcgtattccataccatgtggcacgtcacgcgcggcagcgtgatctgccacgagaccgggcggctagagccctcctgggccgacgtgcgcaacgacatgataagctacggcgggggctggcgcctgggcgacaaatgggacaaggaggaggacgtccaggtattggccatcgagcccggtaagaaccctaagcacgtccagaccaaacccgggttattcaaaaccctgacgggggagatcggcgcagtcactctcgactttaagccggggacatccggcagtcccatcatcaaccgaaagggcaaggtgatcgggttgtacggcaacggggtggtcaccaagtccggcgactacgtgagcgccatcactcaggccgagaggattggggagcccgactacgaggtggacgaggacatcttccggaaaaagcgcctcacaataatggacctccaccccggcgctggcaaaaccaagcggatcctgccgtccatcgtccgcgaggcgctgaagcggcgcctgcgaaccctcatcctggccccgacgcgcgtggtggccgccgaaatggaggaggccctgaggggcctccccatcagataccagacccccgcggtcaaaagcgagcacaccggccgtgagatcgtagacctgatgtgccacgccaccttcacgacgcgcctgctcagctcgacccgggtaccgaattacaacctgatcgtcatggacgaggcccacttcaccgaccccagctccgtagccgcccgagggtatatcagcacgcgggtcgaaatgggggaggcggcggccatcttcatgaccgccacaccacccggggccacagacccattcccccagtctaacagccccatcgaggatatcgagagagagatccccgagcgatcttggaacacgggattcgactggataacggactaccagggtaagaccgtgtggttcgtgccgtcgatcaaagcggggaatgacattgccaactgtctgcgcaagtccggcaagaaggtgatccaactctctagaaaaaccttcgacacggagtaccccaagaccaaactgaccgactgggacttcgtggtgaccacggacatctccgagatgggagccaacttccgggccggccgcgtcatcgacccccggcgctgcctgaagcccgttatcctcacggacgggccggagcgggtaatcctggcaggtcccatccccgtcactcccgccagcgccgcccagcgcaggggccgcatcgggcggaacccagcccaggaggacgatcaatacgtattctccggggaccccctgaagaacgatgaggaccacgcgcactggaccgaggccaagatgctgctggataacatttacacacccgagggaatcatccccaccctgttcggcccggagcgcgagaagacccaggccatcgacggcgagtttcggctccgcggggagcagcggaagacattcgtggagctgatgaggcggggcgatttacccgtgtggctcagctacaaggtggcctccgccgggatctcctacaaagaccgcgagtggtgcttcacgggagagcggaacaaccagattctggaggagaacatggaggtggaaatctggactcgggaaggggagaagaagaaattacggccccgctggctcgacgcgagagtctacgccgaccccatggccctgaaggacttcaaggagttcgcctccgggagaaagagcatcaccctggacattctcaccgaaattgcctccctgccgacctatttgagcagccgcgcgaagctcgccctggacaatattgtgatgctccacacgaccgagagaggcgggcgcgcctaccagcatgctctcaacgaattgcccgagtccctggagaccctcatgctggtggcgctgctcggggccatgactgcgggtatctttctgttcttcatgcaaggcaaggggatcggcaagctgagcatgggcctcatcaccatcgccgtcgcctccgggctgctgtgggtggcagagatccagccacagtggatcgccgccagtattatcctcgagttcttcctgatggtgttgctcatcccggagcccgagaagcagcggacaccccaagataaccagctcatctacgtcatactgaccatcttaacgatcataggcctgattgccgccaacgagatggggttaatcgagaagacgaagaccgacttcggcttctaccaagtgaagaccgagaccacgattctcgatgtggacctgagacccgcctccgcgtggacactgtacgccgtcgccaccactatcctcaccccgatgttgcggcacaccattgagaacacaagcgcaaacctgagtctcgcggctatagccaaccaggccgcagtgctgatggggctgggcaagggctggcccctccaccgcatggacctgggggtgccccttctagctatgggctgctacagccaggtcaaccccaccacgcttaccgcctccctggtgatgctgctcgtgcactacgccatcatagggccgggactgcaggccaaagcgacacgggaggcgcagaagcggaccgccgccgggatcatgaagaaccctacggtagatggcattaccgtgatcgacctggagcccatatcatacgaccccaagttcgagaagcagctgggccaggtgatgctgctcgtcctgtgtgccgggcagctgctcctaatgcggaccacctgggcgttctgcgaggtgctgacgctcgctacgggcccaatcctcaccctgtgggaggggaaccccggccgcttctggaacaccacaatcgccgtgtccaccgctaacattttccggggcagctacctcgcaggggcgggcctggccttttcccttatcaagaacgcccaaacaccccgccggggtaccggcacgaccggggagacactcggtgagaaatggaagcgccagctaaattctctggatcggaaggagttcgaggagtacaagcgcagtggcatcctcgaggtcgaccggaccgaggctaagtcagcgctgaaggacgggtccaagatcaagcacgcggtgagccgcggctcctcaaagatccggtggattgtggagcgcggaatggtcaaacccaagggaaaagtggtggacctggggtgcggcaggggcgggtggagctactatatggccactttaaagaacgtaacggaggtgaagggctacacaaaagggggcccgggccacgaggagcccatccccatggccacctacggctggaacctggtgaagctgcactccggcgtcgacgtattctacaaacccaccgaacaggtggacacgctcctgtgcgatattggggagtcatccagcaacccaactatagaggagggacggaccctgcgcgtcctcaagatggtcgagccctggctgtccagcaagccagagttctgcatcaaggtgctgaacccctatatgcctaccgttatagaggagttagagaagctccagcggaagcacggagggaacctggtgcggtgccccctgtccaggaacagcacgcacgaaatgtactgggtctctggcgccagcgggaacatcgtgtcctccgtcaacacaaccagtaagatgctcctgaaccgcttcaccacgcggcaccgcaagcccacctacgagaaggacgtcgacctgggagcggggacccggagcgtgtccaccgagacggagaagcccgacatgaccatcataggccgtcggctccagcgcctgcaggaggagcacaaggaaacctggcactacgaccaggaaaatccttaccggacatgggcctaccacgggagctacgaggccccctccacgggctccgcctcctccatggtgaacggcgtcgtcaagctgctcaccaaaccctgggacgtgatcccaatggtcacgcagctggccatgaccgacacgacccccttcgggcagcagcgcgtgttcaaggaaaaggtagacacccggacaccccaacccaagccgggtacgcgcatggtaatgacaaccaccgcgaactggttatgggcactcttagggaaaaagaagaatccccgactgtgcacgcgcgaggagttcattagcaaggtgcggtccaacgccgctatcggcgccgtgttccaggaggagcaagggtggaccagcgcgtccgaggccgtcaacgactcacgcttctgggagctcgtggacaaggagcgggcccttcaccaggagggcaagtgcgagtcctgcgtgtacaacatgatgggcaaacgcgaaaagaagctaggggagttcggcagagctaaggggagccgggccatctggtacatgtggctcggcgctcgcttcttggagttcgaggccctggggttcctcaacgaggaccactggttcggtcgggaaaattcgtggagcggggtcgaaggggagggcctgcaccgtctcgggtacatcctcgaggagatcgacaagaaggacggcgacctgatgtacgccgacgacacagccggctgggatacgcggattacggaggacgacctgcagaacgaggagctcattacggagcagatggcgcctcaccataagatcctggccaaggcgatctttaagctgacctaccagaataaggtggtgaaggtcctccgccccaccccgagaggggccgtaatggacatcatttctcgtaaggaccagaggggctcaggacaggtggggacctatgggctgaacaccttcaccaacatggaggtccagctgatccgccagatggaggccgagggcgtgatcacccaggacgacatgcagaaccccaagggcctcaaggagcgagtggagaagtggctgcgagagtgcggggtagaccggctgaagcgcatggcgatctccggcgacgactgcgtggtgaagcccctagacgagcggttcgggacgagcttgctattcctcaacgacatgggcaaagtccgcaaggacattcctcagtgggagccgtccaaggggtggaagaattggcaagaggtacccttctgcagccaccacttccataagatatttatgaaggacggccggagcttagtggtcccctgtcgcaaccaggacgagctgatcggccgggcgcgcatcagtcagggggccggctggtcactgcgcgagaccgcttgcttgggaaaagcgtacgcacaaatgtggagcctgatgtacttccaccggcgcgatctccggttggccagcatggccatttgttccgccgtgcccaccgagtggttccctaccagcagaaccacgtggtccatccacgcccatcaccaatggatgacgaccgaggacatgctgaaggtgtggaaccgcgtctggatcgaggacaaccctaacatgatcgataagacccccgtgcacagctgggaggacatcccatacctcggtaagcgcgaagacctatggtgcgggtccttgatcggactcagctcccgggcgacgtgggccaagaacatccacaccgccatcactcaggtacgcaaccttattggcaaggaggaatacgtcgactacatgccggtgatgaagcggtactctgccccgtccgagtcagagggggtgctatga

SEQ ID NO: 26256 - RNA, 9867 nt, synthetic construct
  misc_feature 1..9867: note = derived and/or modified CDS sequence (opt11) from DENV-4__FJ882601__SS-prME
  source 1..9867: mol_type = other RNA
agcaccatcacactgctgtgcctgattcccactgtgatggccttccacttatcgacccgcgacggagagcccctcatgatcgtggccaagcacgaaagagggcgccccctgctgttcaagaccaccgagggcatcaataagtgcaccctcatcgccatggacctcggggaaatgtgcgaggataccgttacctacaagtgccccctgctcgttaacactgagcccgaagacatcgactgttggtgcaatctgacctcaacctgggtgatgtacgggacctgcacacagtccggggagcgacgcagagaaaaacgcagtgtggccctgaccccgcattccgggatgggcctcgaaacccgggccgagacatggatgagcagtgagggggcctggaagcacgcccagcgtgtagaaagctggatcctgcggaatcccggtttcgcgctgctcgccgggttcatggcctacatgatcggtcagaccgggatccagcgcaccgtattctttgttctcatgatgctggtggccccctcctacggcatgcgttgtgtgggggtgggcaaccgcgacttcgtggagggcgtgtccgggggcgcgtgggtggatttggtgctggagcacggcggttgcgtcactaccatggcgcagggcaagcccaccctggacttcgagctcacgaagaccaccgccaaggaggtggccctgcttcggacttactgcatcgaggcctccatcagtaatattacaaccgcgacacgctgcccgacccaaggcgagccctacctcaaggaggagcaggatcaacagtacatctgccgtcgcgacgtagtggatcggggttgggggaacggctgcggcctgttcgggaaggggggggtggtgacctgcgcgaagttctcctgcagcggcaaaatcaccgggaacctggtccagattgagaacttagaatacaccgttgtggtcactgtacacaacggcgacacccatgccgtcggcaacgacacctccaaccacggggtgaccgcaaccataacgcctcgcagcccctccgtggaggtcaaactcccggactacggcgagctgacactcgactgcgaaccccgatcagggatcgattttaatgagatgattctgatgaagatgaagaaaaaaacctggttagtgcacaagcaatggttcctcgacctgcctttgccctggaccgccggcgcggatacctccgaagtccactggaactacaaagagcgcatggtcacatttaaggtcccgcacgccaagcggcaggacgtgaccgtcctggggagccaggagggcgccatgcactcagcattggccggcgcgaccgaggtggacagtggggacggcaaccacatgtttgccggtcacctgaagtgcaaggtccgcatggagaagctacgcataaaggggatgagctacaccatgtgctcagggaagttcagcatagacaaggagatggcagagacgcagcacgggaccaccgtcgtgaaggtcaagtatgagggcgccggggccccctgcaaggtccccatcgagatccgggacgtgaacaaggagaaggtggtgggtcgcgttatatccagcacgccgttagcggagaacacgaattcggtgaccaacatcgagctggagccgccattcggggacagctacatcgtcatcggcgtcggcaactccgccctcacgctgcactggttccggaagggaagctccatcggcaagatgttcgagtctacataccgcggggccaagcggatggcgatcttaggcgagacggcgtgggacttcgggtccgtgggcggcctgtttacctctctggggaaagccgttcaccaagtgttcggctccgtgtacacaaccatgtttgggggagtaagctggatgattcgcatcctcatcgggttcctcgtactgtggattgggacgaattcccggaacacgagcatggcaatgacgtgcatagcagtgggcgggatcaccctgttcctgggctttacggtccaggccgacatggggtgcgtggtgtcctggagcgggcgcgagctcaagtgcgggagcggtatatttgtcgttgataatgtgcacacatggacggagcaatacaaatttcagcccgagtcccccgctcggctggccagcgcaatcctaaacgcccacaaagacggcgtctgcgggatcaggtccaccacgcggttggagaacgtgatgtggaagcagataacgaacgagctgaattacgtgctgtgggagggcgggcacgatctcaccgtcgtggcgggcgacgtaaaaggtgtcctaacgaaggggaagcgcgcgctgacccctccggtgtcagatctcaaatactcctggaagacctggggcaaggccaaaattttcacccccgaggcacggaactcaacctttctgatcgatgggcctgatacgtccgagtgtccgaacgaacgcagggcctggaacagcttagaagtggaggactacggattcgggatgttcaccaccaatatctggatgaagttccgcgagggctccagtgaggtgtgcgaccaccggctcatgagtgccgctatcaaagaccaaaaagccgttcacgcagacatgggatactggatcgagagctccaagaatcagacctggcagatagaaaaggcctcactaatcgaagtgaagacgtgtctgtggcccaagacccacacgctctggtctaatggggtcctggagtcacagatgctcatccccaagtcctatgcgggcccgttctcgcagcataactaccgccagggatacgccacacaaaccgtgggcccgtggcacctcggtaagctggagatcgactttggcgagtgccccggcacaaccgttaccatccaggaggactgcgaccaccgggggccaagcctgaggaccacgaccgcgtccggcaagttggtcactcagtggtgctgccgcagctgtacaatgccgccactgcgtttcctgggggaggacggatgctggtacgggatggagattcgtcccttatccgagaaggaggaaaacatggtcaaatcacaggttgccgccggccagggcacatccgagaccttcagcatggggttactttgccttaccctgttcgtagaagagtgcctacggagaagagtgactcgtaagcacatgatacttgcagtcgtgatcacgctgtgtgccattatcctgggcgggctcacctggatggacctgctgcgggctctcatcatgctgggagacaccatgtccggccgcatcgggggccaaacccacttggccataatggccgtgtttaagatgtcccccgggtacgtactcggcgtgttcctgcggaagctgacaagtcgcgagaccgcattgatggtgatcggtatggccatgaccaccacgctgagcatccctcacgacctgatggaactcatcgacggcatatcccttggcctgatactcctgaagatagtcacccagttcgacaacacccaggtgggcaccctagcactctccctgacgttcatccgctccacaatgagcctggtgatggcctggcgcaccatcatggccgtgctcttcgtggtcaccctgatccccctgtgccgcaccagctgcctccagaagcagagccactgggtcgagatcaccgcgctgatcctgggcgcccaggccttgcccgtgtacctcatgacattaatgaagggggcctcccgccggagctggcctctcaacgagggcatcatggcggtcgggctggtgtccctgctcggctcggccctgctgaaaaatgacgtgccgctggccgggcccatggtggccggcggtctgctgctggcagcgtacgtcatgtccgggagtagcgccgatctgtccctagagaaagccgccaacgtgcagtgggatgaaatggccgacatcaccggcagctctcccattatcgaggtgaagcaggacgaggacgggagcttcagtatacgcgacgtggaagagacgaatatgataaccctattggtgaaacttgcgctcataaccgtgagcggcctatacccgctggccatccccgtcacaatgacgttatggtatatgtggcaggttaagacgcagagatccggcgcgctctgggacgttccaagtcccgccgccacacaaaaggcggccctgtccgagggggtctatcgcatcatgcagcggggcctctttgggaagacccaagtgggcgtggggatccacatggagggcgtcttccacaccatgtggcacgtgacacgcggcagcgtgatctgccacgagaccggacgtctggagccttcctgggccgacgttcgcaacgacatgatcagctacggcggggggtggcgactgggcgacaagtgggacaaagaggaggatgttcaggtgctcgccatcgagccggggaaaaacccgaagcatgtccaaaccaagccgggcctgttcaagacgctgacaggggaaatcggcgctgtgaccctcgacttcaagcccggcacttccggctcgccgatcgtaaacagaaaaggtaaggtcatcggactgtacggcaacggggtcgtgaccaagtccggcgactatgtatcagcgatcacgcaggccgagcgcatcggcgagccagattacgaggtggacgaggacatcttccggaagaagcgactcactattatggacctccatcccggcgctgggaagaccaagagaattctgccgtccatagtgcgggaggcccttaagcgtaggctgcggaccttgatcctggcgcccacgcgcgtcgtggccgctgaaatggaggaggcgctgcggggcctgcccatcagataccagacgccggccgtcaaatctgagcacacaggccgggagatcgtcgacctgatgtgccacgcgaccttcacaacccgccttctcagctccaccagggtgcctaattacaacctgatcgtcatggacgaggcccacttcaccgaccccagctctgtggccgcccgcgggtacattagcacgcgggtggagatgggcgaggccgcggccatcttcatgaccgctaccccgcccggagccaccgacccgtttccccagtccaacagccccatcgaggacatcgaacgcgagatccccgagcggtcctggaacacgggcttcgattggatcacagactaccagggtaagaccgtctggttcgtgccgagcatcaaggcagggaacgacatcgccaactgcctccgcaagtccggcaagaaggtaatccagttaagccgcaagacctttgacacggagtaccccaagaccaagctgaccgattgggactttgtcgtgaccacggacatttccgagatgggggcgaacttcagggcaggccgcgtgatcgacccccggcgctgtcttaagcccgtcatcttaaccgacgggccagagcgggttatcctggccggccccatccccgtgacccccgcgagcgccgcccagaggcggggccgcatcggccggaaccccgcccaggaggatgaccagtacgtcttctccggcgatcccctgaagaacgatgaggaccacgcccactggaccgaggcgaagatgctcctggataacatctacacccccgagggaataatccccaccctgttcgggccggaacgtgagaagacccaagctatcgacggagagtttcggttacgaggggagcaacggaaaaccttcgtggagctgatgcgccggggggatctgcccgtgtggctctcatacaaggtagcctccgccgggatcagctacaaggaccgggaatggtgcttcacgggcgaacggaacaaccagatactggaagagaatatggaagtagagatatggacacgcgagggtgaaaagaaaaaactgcggccccgatggctggatgctcgggtgtacgctgaccccatggcactgaaagacttcaaggagttcgcttccggccggaagagcatcaccttggacatcttaaccgagatcgcctccctaccgacctacttgagctctcgcgccaagctcgctcttgacaacatcgtcatgctgcacacgaccgagagaggcgggcgcgcttaccagcacgcccttaacgagctccccgaatccctggaaaccctcatgctcgtagccctgctcggcgctatgaccgcggggatcttccttttcttcatgcagggcaaagggattggcaaactgagcatggggctcatcacgatcgccgtggcctccgggctgctctgggtcgcagagatccagccccagtggatcgcggcctcgattatcctcgaattcttcctgatggtgctgctcatcccggagcccgaaaagcagcggacgccccaggacaatcagctgatatacgtcatactggccatcctcaccattatcggcctgatagccgcaaacgaaatggggctgatcgagaagacgaaaaccgacttcgggttctaccaggagaagaccgagacgaccatactcgatgtcgacctgcgccccgcgtccgcctggacgctgtacgccgtggccacaaccatactcaccccgatgctgcggcacaccatcgagaacaccagcgccaacctgtccctcacggcgatcgcgaatcaagccgctgtgttaatgggtctgggcaagggctggccactccaccgcatggacctgggagtcccgctgcttgccatgggctgttacagccaggtgaaccccaccacgctgaccgcctccctggtgatgctcctggtccactatgcaatcatcgggccgggcttacaggccaaagccaccagggaggctctcaagcgcaccgcagccggcatcatgaaaaaccccacggtcgacgggatcaccgtgatcgacctggaaccgatcagctacgatcccaagtttgaaaaacaactgggccaggttatgctcctggtgctctgcgccggtcagctcctgctgatgcgcaccacctgggccttttgcgaggtgctcacgctggctaccggaccgatcctgactctctgggaggggaaccccggaaggttttggaacaccacgatcgccgtgtccaccgcaaatatctttcggggcagctatttggccggggccggcctagcgttctccctcattaaaaacgtacagacacctcggagggggaccggcacgaccggggagaccctgggcgagaaatggaagcgccagctgaacagcctcgaccggaaggaattcgaagagtacaaacggtccggcatcttggaagtggaccgaaccgaggccaaaagcgccctgaaggacggctctaaaataaagcacgcggtcagccgcggttcctccaagatccggtggatcgtggaacgcgggatggtgaagccgaagggcaaggtcgtggacctcgggtgcggccgcggtgggtggagctactacatggccacactgaagaacgtgacagaggtcaagggatacaccaagggtgggccggggcacgaagagcccatacctatggcgacgtacggatggaacctagtgaagctccactccggcgtggacgtcttctacaagcccaccgagcaggtagacacattactgtgcgacataggggagagctccagcaacccgacgattgaggagggccggaccctccgggtgctgaagatggttgagccctggctgtcctctaagccagagttctgcatcaaagtgttgaacccctacatgccgaccgtcatcgaggaactagaaaagctgcagcggaagcacgggggcaacctggtgcgctgccccttgtccagaaatagcacgcacgagatgtactgggtgtccggcgccagcggcaacatcgtctctagcgtgaacaccaccagtaagatgctactaaaccgctttaccacacgacaccgtaagcccacgtacgagaaggacgtggacctcggcgccgggacgcggtctgtctccaccgagacagaaaagccagatatgaccatcatcggccgccggctgcagaggctccaggaggaacacaaggagacctggcattacgaccaggagaacccgtaccggacctgggcctatcacggtagctatgaggcgccctcaacgggctcagcctccagcatggtgaacggcgtggtaaagctgctgaccaaaccatgggatgtgattccgatggtgacacagctggccatgacggacacgactcccttcgggcagcagagagtcttcaaggagaaggtggacacccggacgccccaacccaaaccgggcacacgcatggtaatgacgactaccgctaactggctctgggccctgttaggaaagaaaaagaaccccagactctgcacgcgcgaggagttcatcagcaaggtgcggtccaatgcagccatcggcgccgtgttccaggaggagcaggggtggaccagcgcctccgaagccgtgaacgactctcgcttttgggagttggtcgataaggagcgggcactgcaccaggagggcaagtgcgagtcttgcgtgtacaacatgatgggcaagcgcgagaagaaactcggggaattcggcagggccaaggggtcacgggccatttggtacatgtggctgggcgcccgcttcctggagttcgaggccctcggattcctgaacgaggaccactggttcggcagggagaactcttggagcggagtggaaggggagggcttgcaccgcctcggatacatactggaggagattgacaagaaagatggtgatctgatgtatgcggacgataccgccggctgggacacaagaatcacggaggacgacctccagaatgaggaactggtgaccgagcagatggctccccaccacaagatcctggctaaggcgatcttcaagctcacctaccagaataaggtggtgaaggtcctgagacccaccccgcgcggggccgtaatggacatcatctcccgcaaggaccagcggggcagcggacaggtcggcacctacgggctgaacacgttcaccaacatggaggtccagctgatccgccagatggaggccgagggggtgattacccaggacgatatgcagaaccccaaggggctgaaggagcgggtggagaagtggttgcgcgagtgcggggtcgatcggcttaagcgcatggccattagtggggacgactgcgtggtgaagccgctggatgaacggttcgggaccagcctcctgttccttaatgacatggggaaggtccgaaaagacattccccaatgggagccgtccaaggggtggaagaactggcaggaggtgcctttctgtagccaccatttccacaagatcttcatgaaggacggacggtcactggtggtcccctgccgcaatcaggacgagctcatcggcagggcccgcatcagccagggcgccggctggtccctgcgcgagacggcatgtttgggcaaggcctatgcccaaatgtggtccttaatgtacttccatcggcgcgatctgcggcttgccagcatggcaatatgctccgccgttcccaccgagtggttccccaccagccgcaccacgtggtccatccacgcccaccatcagtggatgaccaccgaggacatgcttaaggtgtggaatcgggtgtggatcgaggataaccccaacatgattgacaagacccccgtgcacagctgggaggacatcccctacctaggcaaacgtgaggacttatggtgcggttccctcatcggcttaagctcccgggcaacgtgggcgaagaacatccacacggcgatcacccaggtgcgcaacttgatcggcaaagaggagtatgtcgactacatgccagtaatgaaaaggtacagcgccccatcagagagcgagggggttctctga

SEQ ID NO: 26257 - RNA, 9867 nt, synthetic construct
  misc_feature 1..9867: note = derived and/or modified CDS sequence (opt11) from DENV-4__FJ226067__SS-prME
  source 1..9867: mol_type = other RNA
tcgaccatcaccttattgtgcctgatacccaccgtgatggccttccacttgtccacccgggacggtgagccattaatgattgttgccaagcacgaacgggggcggcccctgttgttcaagaccaccgagggtatcaacaagtgcaccttgatcgccatggacctgggggagatgtgcgaggacaccgttacgtataagtgtcccctgctcgtgaataccgagcccgaggatatcgactgctggtgcaacctgacctcgacctgggtgatgtacgggacttgcactcaatccggtgagcgacgtcgggagaagcgttctgtggctctgacccctcactcggggatggggctcgagacgcgggccgagacctggatgagctccgagggagcctggaagcacgcccaacgtgtggagtcttggatcctgcggaacccaggcttcgctctgcttgccggatttatggcctacatgatcggccagaccgggatccagcgcaccgtgttcttcgtgctaatgatgctggtggccccatcctacggcatgcgttgcgtcggggtcggtaaccgcgacttcgtggagggcgttagcgggggcgcgtgggtggacctcgtgctggagcacggcgggtgcgtgaccaccatggcccagggcaagccgaccctggacttcgagctcacgaagactacagctaaggaggtggccctgctgcggacctactgcatcgaggcttccatcagcaacatcacaaccgcgacccgctgtccgacccaaggtgaaccatacctgaaggaggagcaggaccagcagtacatttgcaggcgagacgttgtggaccgtggctgggggaacggctgcggtctgttcgggaagggcggggtggtgacgtgcgcgaagttttcctgcagcggtaagataacagggaacctggtccaaatcgaaaacttagagtacaccgtagtagtcactgtgcataatggtgatacgcacgccgtaggtaatgacacttccaaccacggggtaacagccaccatcactccccgctcaccctccgtggaggtaaaacttccggattacggagaattgaccctcgactgtgagccccggagcggaatcgatttcaatgagatgatcctgatgaagatgaagaagaagacctggttagtgcacaagcagtggttcctcgacctgcccctgccctggacagccggcgcggatacctccgaggttcactggaactataaggagcgcatggtgacgtttaaggtgcctcacgcaaagagacaagacgtgactgtcctcgggagccaggagggcgccatgcacagcgccctagctggcgcgactgaggtggattccggggacggcaaccacatgttcgccgggcacctgaagtgcaaggtgcgtatggagaaactccgcataaagggcatgagctacaccatgtgctctggaaagttcagcatcgacaaagagatggccgagacgcagcatgggaccacggtcgtgaaggtgaagtatgagggagcgggggccccctgcaaggtccccatcgagatccgggacgtaaacaaagagaaggtcgtcggccgcgttatatcctccacgcccctcgcggagaatacgaactccgtgaccaacatcgagttggagccgcccttcggcgatagctacatagtcatcggggtgggaaattccgcattgacactgcactggtttcggcgcggttcctccatcggcaagatgtttgaatctacataccgcggggccaagaggatggccatcctaggcgagacggcgtgggacttcggatcagtgggcggtttgttcaccagtctcgggaaggccgtccaccaggtgttcggctcagtgtataccacgatgttcgggggagtctcatggatgatacggatactgatagggtttctcgtgctgtggatcggaactaactcccgcaacacctctatggccatgacttgcataacagtgggtgggatcacgctgttcttgggcttcaccgtccaggccgatatggggtgcgtggtgtcttggtcaggccgggaacttaagtgcgggagcggcatcttcgtcgtggataacgtgcacacatggaccgagcaatacaaattccaacccgagtcgcccgctcgcctggcctctgccatcctgaatgcccataaagacggcgtctgtgggatccggtctacgacccgactcgagaacgtgatgtggaagcaaatcaccaacgagctaaattacgccctgtgggagggaggacacgacctcacagtagtggcgggagacgtgaaaggcgtgctgactaagggtaagagagctctgactccgcctgtcagcgacctcaagtactcttggaagacatggggcaaggcaaagatatttacgcccgaggcccgcaacagcacattcttaatcgacggccccgacacctccgagtgcccgaatgagcggcgcgcgtggaactctctagaggtagaggactacggcttcgggatgttcaccaccaacatctggatgaaattccgggagggctccagcgaagtgtgcgatcaccggctcatgtccgcggcgataaaggaccaaaaggccgtacacgccgacatgggctattggatcgaatcttccaagaaccagacttggcagatagagaaggccagcctaatcgaagtcaagacctgcctgtggcctaagacccacacattgtggagcaacggggttctggagtcacagatgctgatccctaagtcctatgcaggcccgtttagccagcacaactaccgacaggggtacgccacccagaccgtcggaccatggcaccttggcaaacttgaaatcgacttcggagaatgccccggaaccacagtgaccatccaggaggattgcgaccaccgcgggccctccctccgcaccaccaccgcctccggcaagctcgtgacgcagtggtgctgccggtcctgtacgatgccgccccttagattcctgggggaggacggctgctggtacgggatggagattcggcctctctccgagaaggaggagaacatggtcaagagccaggtgactgcaggccagggtacatccgagaccttcagcatgggtttactttgcctaacactcttcgtcgaggagtgcctgcgccgtcgggtgacccggaagcacatgatcctcgttgtcgtgatcaccctgtgcgccattatcttgggcggactcacttggatggacctgctgcgcgcgctcattatgctgggcgacacgatgagcggcagaatagggggccagatccacctggccatcatggcggtgttcaagatgagcccaggatacgtcctcggcgtgtttctgaggaagctcacctcccgggagaccgccctcatggtgatcggtatggccatgaccacggtcctgagcataccccacgacctgatggagctaatcgacggcatctccctgggcctcattttactcaagatcgtcacccagttcgacaacacccaagtggggaccctggctctcagcctgacgtttattcgctccacaatgcccctggttatggcctggcgaaccatcatggccgtcctcttcgtggtgacattgatccccctgtgccgcacgagctgcttgcagaagcagtcccattgggtggaaattactgccctgatcctgggcgcgcaggcgctccccgtctacctgatgaccctgatgaagggggccagccggcgttcttggcccctcaatgagggcatcatggccgtcgggttagtgagccttctcggctcggcactgctgaagaacgacgtcccgctcgccgggcccatggtggccgggggcttgctgctcgccgcctacgtgatgtctggctccagcgcagacttgagcctggagaaggccgccaacgtccagtgggatgagatggccgacatcaccgggtcctctcctataatagaggtcaagcaggacgaagatggatccttcagcataagagacgtggaggagactaacatgatcaccctcctcgtaaagttagccttgattactgtctccggactgtacccgctggccattcccgtgactatgacgctatggtatatgtggcaggttaagacacagcggagcggcgctctgtgggacgtgccctcacccgccgcgacccagaaggcagccctgagcgagggggtgtatcggatcatgcagcgtggcctattcggcaagacccaggttggcgtcgggattcatatggagggcgtgttccacactatgtggcacgtgacgcggggaagtgtcatttgccacgagaccgggaggcttgagccgagttgggcggacgtgcgcaacgacatgatatcctacggcgggggttggcggttaggagacaagtgggataaggaggaggacgtgcaggtactcgccatcgaacctgggaagaaccccaagcacgtgcagaccaagcccggactgtttaagacgcttaccggggagatcggggcggtcaccctagacttcaagccggggacaagcggctcccccatcatcaacaggaaaggaaaggtcatcgggctgtacggcaacggggtggtaaccaagagtggcgactatgtctctgccattacacaagccgaacggatcggtgagcccgactatgaagtggacgaggatatcttccgaaagaagcggttgacgatcatggacttacaccctggcgcgggcaaaacgaaaaggatcttacccagcatcgtccgggaggccctgaaacgcagactgaggacattaatcctggcccctacgcgggtcgtagccgccgaaatggaggaggccctgagggggttgccaatccggtatcagacgccagccgtcaagtccgaacacacaggccgagagatcgtcgatctgatgtgccacgccaccttcaccactcggctgctcagcagcacgcgcgtgcccaattataacctgattgtcatggatgaggcccattttacggatccatcatcagttgcagcccgggggtacatctccacgagagtggaaatgggcgaggccgcagccatcttcatgaccgctacgccaccgggggccacagacccattcccccagagtaacagtcccatcgaagacatcgagcgggaaattccggagcgcagctggaacacgggattcgactggatcacagactaccaaggcaaaacggtctggttcgtgccgtcgattaaggccgggaacgacatcgccaactgtctgcgcaagagcggcaagaaagtgatccagctgtcccggaaaaccttcgacacggagtatcccaaaactaagctgaccgactgggactttgtcgtgaccacagacatcagcgagatgggggccaatttccgtgcgggacgggtgatcgacccgaggcggtgcctgaagccggtcatcctcaccgacggacccgaacgggtgatcctggcaggccccattccggtgaccccggcctctgccgcccagcggcggggccggataggtcgcaacccggcccaagaagacgaccagtacgtcttcagtggcgatcccctgaagaatgacgaagaccacgcccactggaccgaggcgaagatgcttctggacaacatatatacgcccgaggggattatcccgaccttattcggcccagaacgggagaaaacccaggccatcgacggggagttccgcttgagaggggagcagcgcaagacctttgtggaacttatgcggcgcggcgatctgcccgtatggctatcctacaaagtcgcgagcgccgggatctcgtacaaggaccgggagtggtgcttcacgggcgagcggaacaatcagatcttagaggagaatatggaggtggaaatctggactcgggaaggggagaaaaagaagctgcggcccaggtggctcgacgcccgcgtttacgcggaccctatggccctgaaggacttcaaggagttcgcttctggcagaaagtctatcaccctagacatacttaccgagatcgcctcgctgccgacctacctgagcagcagggcgaagctcgccctggacaacattgtcatgctgcacacgaccgagcgtggtgggcgggcgtaccagcatgcgcttaacgagctgcccgagagtctggagaccctcatgctagtggccctcctcggcgccatgaccgccgggattttcctgtttttcatgcagggcaaggggatcggaaaattatctatgggcctcatcgcaattgcagtggccagcggtctgctttgggtcgccgagatccagccgcagtggatcgcggcttccataatcctcgagttctttctgatggtactgctaatacccgagcccgagaagcagcgcacgccgcaagacaatcaactcatctacgttattctgacaatcctaacgatcatcggcctgatcgccgcaaatgaaatggggctgatcgaaaagaccaaaacggacttcggattttaccaggtcaagaccgagaccactatccttgacgtggacctgcggccggcctcggcatggacgctgtatgctgtcgcgaccacaatcctcacccccatgctgcgccacacgatcgagaatacctccgccaacctgagcctcgccgccatcgcgaaccaggctgcagtcctgatggggctcgggaaaggctggcctcttcaccggatggacttaggagtgcccctgctcgccatggggtgttactcccaggtgaatccgaccaccctgacggccagcttggtcatgctattggtgcactatgccattatcgggccaggcctgcaagccaaggcaacccgagaggcccagaagcgtacggcggccggcatcatgaagaaccccaccgtggacgggatcacagtcatcgacctcgagcccatctcttatgaccccaagttcgagaagcagctgggccaggtgatgctactcgtgctctgcgccgggcagcttctcctcatgcgtaccacctgggctttttgtgaggtcctaaccctcgccacgggccccatactgaccctatgggaagggaatcctggccggttttggaacacgaccatcgcggttagcacagccaacatcttccggggctcctaccttgccggggccggcctagccttcagcctgatcaagaacgcacagacgccccggcgcggtactgggacaacgggggagacactcggcgagaagtggaagcggcagctgaactcacttgaccgcaaggagtttgaggagtacaagcggtccggcatcttagaggtggaccgcaccgaggccaaatccgccttgaaggacgggagtaaaataaagcacgcggtctcccggggcagttccaagatccgctggatcgtagagcgcggcatggtgaagccgaagggtaaggtcgtggacttggggtgcggccggggcgggtggtcgtactacatggcgactttaaagaacgtgaccgaagtcaagggctacacgaaaggcggtccagggcacgaagaaccgatccccatggcgacgtacggctggaaccttgttaagctgcacagcggggtggacgtcttctacaagcccaccgagcaggtcgacacgctcctgtgcgacatcggtgagtccagctcaaaccccacgatcgaagagggccggaccctgcgggtgcttaaaatggtcgagccctggctgagcagcaagccggagttttgcatcaaggtgctgaacccctacatgcctactgtcatcgaggagttagagaaactccagagaaagcacgggggcaacctggtgaggtgtcccttaagccggaactccactcacgagatgtattgggtcagtggagcctccgggaacatcgtcagttccgtgaatacgacctcgaagatgctcctcaatcggttcaccacccgccaccggaagccgacgtacgagaaggacgtggacctgggtgccggcacccgctccgttagcaccgaaaccgaaaagccggatatgacgatcatcggtcgccgcctccagcggctccaggaggagcacaaagagacctggcactacgaccaggaaaacccctaccgcacttgggcctatcacgggtcctatgaggcgcccagcaccgggtccgccagcagcatggttaatggcgtggtaaagttactcaccaagccgtgggatgtgattcccatggtgacccagctggccatgacagacaccacgcccttcggacagcaacgggtgttcaaggaaaaggtggacacgcgcacgccccagccgaagcccggcacccggatggtcatgacgaccacggccaattggctctgggcactcctggggaagaagaaaaacccccgcctatgcacccgggaagagttcatcagcaaggtacggtctaacgctgccatcggagccgtgttccaagaagaacagggatggacctccgccagcgaggccgtgaatgactcccgtttctgggagctcgtcgataaggaacgcgcgttgcatcaggagggcaagtgcgagtcttgcgtttacaacatgatggggaagcgcgagaagaagctgggggagttcggtagagccaaggggtcccgcgccatctggtacatgtggctcggcgcccgattcctagagtttgaggccctggggtttctaaacgaggaccattggttcggccgagaaaacagttggtccggcgtggagggcgagggcctgcaccgtctggggtacatccttgaggagatcgacaagaaggacggcgacctgatgtacgcggacgacacagccggctgggatacgcgcataacagaggacgacctgcagaacgaggagctcataaccgaacaaatggccccgcaccataagatcctggccaaggctatattcaagctgacctaccagaacaaggtcgtgaaggtgcttcggccaacaccccgcggggccgtcatggacatcatctctagaaaggaccagcgcggctccggtcaggtgggaacctacgggctcaacacattcacgaacatggaggtgcaactgatacgtcaaatggaggcagagggagtcatcacccaggatgacatgcagaaccccaaggggctaaaggagcgcgtagagaagtggctgcgtgagtgcggggtcgatcgcctgaagcgtatggccatcagcggcgacgattgcgtcgtgaagcccctcgacgaacgctttgggacctccctactgttcctcaatgacatgggcaaggtgcggaaggatattccacagtgggaacccagcaaggggtggaagaactggcaagaggtccctttctgttcccaccacttccacaaaattttcatgaaagacggccgctctttggtggtgccctgccggaaccaggacgaactgatcggacgcgcccgcatctcccaaggggcgggctggagcttacgggagacagcctgtctggggaaggcctatgctcagatgtggtctctgatgtacttccaccgccgagatctccgcctggcctccatggccatctgcagcgccgtccccacggaatggttccccacatccaggactacttggtccattcacgcccaccaccagtggatgacaaccgaagacatgttgaaggtgtggaaccgcgtttggatcgaggacaaccccaatatgaccgacaagacccccgtccactcctgggaggacatcccgtatctcggcaaacgggaggacctgtggtgcgggtccctgatcggcctatccagtagggccacgtgggccaagaacatacacaccgcgatcacccaggtgcgcaacctgattggcaaggaggagtacgtggactacatgcccgtcatgaagcgctactcggcgctctcggagtcggagggggtgctctag

SEQ ID NO: 26258 - RNA, 9867 nt, synthetic construct
  misc_feature 1..9867: note = derived and/or modified CDS sequence (opt11) from DENV-4__EU854299__SS-prME
  source 1..9867: mol_type = other RNA
tcaaccataaccttgctctgcctaatacccaccgtcatggcctttcacctctcgacacgggatggagaaccactaatgatagtggccaaacacgaacgggggcgtcctcttttatttaaaaccaccgaaggcataaacaaatgcacgttgattgccatggacttaggggaaatgtgtgaagatacggtaacgtacaaatgcccgctacttgtcaacacagaacctgaagacatcgattgctggtgcaacctaacgtcgacatgggttatgtacggaacgtgcacccagtccggcgaacgtcggcgagagaaaaggtccgtcgcactgactccccattcagggatgggcctggaaaccagagcagaaacatggatgtcctccgaaggagcttggaagcatgcccaacgagtcgaaagctggatcttaagaaatcccgggttcgccttactagcgggattcatggcatacatgatagggcaaacgggcatccaacgcacggtatttttcgtgttaatgatgttggtcgccccgagctacggaatgaggtgtgtgggtgttggaaacagagatttcgttgaaggcgtaagtggtggggcttgggtagacctagtgctagaacacgggggttgcgtcacgaccatggcccagggaaaacctacgctcgacttcgaactaacaaaaaccacagctaaagaggtcgcactgttgaggacctactgtatcgaggcactaatcagcaacatcacgacagcaacacggtgccctacccaaggagaaccctacctgaaggaagaacaggaccaacagtacatctgtaggcgtgacgtagtagaccgcggatggggcaacggttgcggcctcttcggaaaaggcggcgtagtaacttgcgcaaaattctcgtgctccgggaaaatcacaggtaacctcgtccaaattgagaatctagagtatacagtagtggttacagtacacaacggcgacacacatgcggtagggaatgacacatcgaaccacggcgtaacagcaacaattacacctcggagcccgtccgtagaagtcaaactgccagactatggggaactgacactcgactgcgaaccacgatcaggtatagacttcaacgaaatgattctaatgaagatgaagaaaaagacgtggctagtacacaaacagtggttcctggacctacccctaccgtggaccaccggggctgatacctccgaggtccactggaactataaagaaaggatggtgacgttcaaggtaccacatgcgaaaaggcaagacgtaacggtattgggcagccaggaaggcgccatgcacagtgcgctcgcgggcgcaaccgaagtggactccggcgacggcaaccacatgttcgccggacacttaaaatgcaaagtcagaatggaaaagttacgaattaaaggcatgagctacaccatgtgcagcggcaagtttagcatcgacaaagaaatggctgaaacacagcacggaacgacagtagtgaaggtaaagtacgaaggagcgggcgccccgtgcaaggtccccatagaaatacgagacgtcaacaaagagaaagtggtgggaagagtgatatcggccacacccctcgccgaaaacacgaatagtgttactaatattgaacttgagccacccttcggtgacagttacatcgtgatcggcgtaggcaactccgcgttgacattacattggtttaggaaaggatcctcgatcggaaaaatgtttgaatcaacctacagaggggccaaaagaatggccatactgggtgaaacagcatgggattttggctcggtaggaggcttgttcacctccctaggcaaagccgtgcaccaagtattcggcagtgtgtataccacaatgtttggaggggtctcctggatgatacgcatcctcatcggatttctggttctgtggatcggtaccaacagccggaacacgtcaatggcaatgacatgtatcgcagtaggagggatcacgctctttctcgggttcaccgtacaggcggacatgggatgcgtggttagttggagtggacgggaactgaaatgtggaagcggtatattcgtcgtagataatgtccacacgtggaccgaacagtataaattccaaccagagagccccgcccgtctagcatccgcaatcttaaacgcgcataaagacggcgtttgcggtatacgtagtaccacacgactcgaaaacgtgatgtggaagcagataacgaacgaattaaactatgtgctgtgggagggcggtcacgatcttacggtcgtcgccggagatgtgaaaggtgtgctcaccaagggaaaacgcgccttaaccccacccgcctctgacctaaaatatagctggaaaacttggggaaaagccaaaatatttacacccgaggcccgcaactcgaccttcctcatcgacggacccgatacatccgaatgccccaatgaaagacgagcctggaactccttcgaagtggaggactacggcttcggcatgttcacaacaaacatatggatgaaatttagagaggggagctcagaggtatgcgaccaccgtcttatgtccgccgcaatcaaagaccaaaaagcagtacacgcagacatgggctactggatagaaagttctaaaaatcaaacatggcagattgaacgagcatcactaatcgaggtcaaaacctgcctttggccaaagacgcatacactatggtcaaacggcgtcttggaaagccaaatgttaattcccaaaagctacgcggggcccttctcacaacataattaccgacaaggttatgccacccagacagtaggtccttggcacctaggaaaattggaaatagactttggtgagtgcccaggtacgacagtcacgatccaagaaaactgcgaccaccgaggaccatctctgagaacaaccaccgcttccgggaaactcgtgacacagtggtgctgtcggtcgtgcacaatgccccctctccgattcctaggagaagacgggtgctggtacggaatggagatccgaccactatctgaaaaagaagagaacatggtaaaatcccaagttaccgcaggacaagggacaagcgagacgttctccatgggactgttatgcctcacgcttttcgtcgaagagtgcctaagacggcgtgtcacgaggaagcacatgatcctcgcggtcgtaatcacactatgcgccatcatattgggaggactaacctggatggacttgctcagagcgcttatcatgctgggcgacacaatgtcaggacgcatcggaggccagacccatttagcgatcatggccgtattcaagatgagccccggatacgtcctgggggtatttttacgaaagctcacctcacgcgaaaccgcactcatggtaattggcatggcaatgacgacgacgctcagtataccacacgatctaatggaactcatcgacggaatctcgctaggactcatcctactgaagatcgtaacgcaattcgacaacacccaagtgggtaccctggcactttccctgacattcataaggtctaccatgtccctggtcatggcgtggcgcacgatcatggccgtcctgttcgttgtaacactgattcctctatgccggacatcgtgcctgcaaaaacaatcgcactgggtagaaataacagcattgatattaggagcccaggcattgcccgtgtacctcatgaccctgatgaagggggcatcacgacgttcctggcccctgaacgaaggaatcatggccgtgggcctcgtgagcctgctaggctcggccttgttgaaaaacgatgtaccactcgcgggtcccatggtagcgggagggctgttgttggccgcgtacgttatgtcagggagctcagcagacctctcgcttgaaaaagcggccaatgttcaatgggacgagatggcggatataacagggagcagccctataatcgaggtcaagcaggacgaagacgggtcattctcgataagagatgtagaggaaacgaacatgataacgctcttagtaaagctagccctgatcactgtgtcagggctctaccctctagcgatccctattacaatgacactatggtacatgtggcaggtcaaaactcaaaggagcggagcgctgtgggacgtgccgtctcccgccgccacccagaaggcagcattgagcgaaggcgtataccggatcatgcagagaggactcttcggaaagacacaagttggcgtgggcatccacatggaaggagtattccacacaatgtggcacgtcacccgcgggtccgtgatttgccatgaaactgggcgattagagccaagttgggcagacgtccgcaacgacatgatatcgtatggtggtggctggagactgggcgataaatgggacaaggaagaagacgtgcaagtactggcaatagaaccaggaaagaaccccaaacatgttcagaccaagccagggctattcaagacattaacgggcgagataggcgcggtaacactagactttaaacccggaacctcgggctccccgatcatcaatcgcaaaggaaaggtgattggactctacggcaacggcgttgtaacgaaaagtggcgattacgtaagtgcgataacccaagctgaacggatcggcgagccagactacgaagtggatgaagacattttccgcaagaagaggctaacaattatggacctgcatccgggggctggaaaaacaaaacggatcctcccctccatagtaagggaggcactcaaacgcagattgcgtacattgatattggcacccacaagagtagtcgcggcagaaatggaggaagcgctaagaggactcccaatacgctaccagacacccgcagtcaaatcagagcataccgggcgagagattgtagacctcatgtgtcacgcgacattcactacacggctattatcatccacaagagtcccaaactacaacctcatcgtgatggacgaagctcatttcactgacccgtccagcgtggcggcacgaggatatattagcacccgagtagaaatgggagaagcagctgccatctttatgactgcaacccctcccggagccaccgatccgttcccacaatctaactcgccaatagaagacatagagcgcgagatacctgaacgaagttggaacacaggtttcgactggatcacagactaccaggggaaaacagtctggttcgtccctagcatcaaagcgggaaacgatattgcaaactgcctacggaaatcggggaagaaagtaatacagctatcgcggaaaactttcgacacggagtacccaaaaactaaactcacagactgggacttcgtggtaaccaccgacatctccgaaatgggggctaacttccgggcagggagagtcatcgaccccagacggtgcctaaaacccgttatcctcacagacggacccgaacgggtcattctggctggccctattcccgtaactcccgcatcagcggcacagcgacgcggaagaatcggacggaatcccgcacaagaagatgaccaatacgtattctcgggggacccactaaagaatgatgaggaccacgctcactggacggaagctaaaatgctgttagacaacatctatacccctgagggaatcatcccaacgcttttcggcccggagagggagaagacgcaagcaatagacggagagttcaggctcagaggagagcaaaggaaaacgtttgtggagctaatgcggaggggtgacctacccgtgtggctgagctacaaggtagcatcggcaggcattagttacaaggaccgtgagtggtgcttcaccggggagagaaacaaccaaatcctcgaggagaacatggaagtcgaaatatggacccgagaaggcgagaaaaagaaactgagacccaaatggctggacgcacgggtgtacgccgatccgatggccctgaaagatttcaaggaatttgcttccggccgaaaatcaataacattagacattctcaccgaaatcgcgtcactacccacgtacctaagttcgagagccaaattagccttagacaacatagtcatgctccacacgacggaacggggcggccgagcataccaacatgcccttaacgagttgccggagagcttagagacgctaatgctcgtagccctcctcggcgcgatgacagctggcatatttctcttctttatgcaggggaaaggaataggcaaattaagtatggggttaatcacgatagctgtagcatcaggcttattgtgggtagccgagatccagccgcaatggatcgcggcttcaataatactagaatttttcctaatggtgctactaataccggagccggagaagcaacgaacaccgcaggacaaccaactcatatacgtcatccttacgatactcaccataatcggcctcatagcagcaaatgagatggggctaatcgagaaaacaaagaccgattttggtttctaccaggtcaagacagagacgactatcctggacgtggatttgagacccgcgtcggcttggacactgtatgcggtagcaaccacaattcttacgccgatgctccggcatactatagagaatacgtcagcaaacctatcgttagcggcaatagccaaccaggcagccgtgctcatggggctcggaaaagggtggcccctgcaccgaatggacctcggcgtgccactgttagccatgggatgttacagtcaggttaaccccacaactcttacagcaagcctggtcatgctcctagtccattacgcaatcatcggcccagggctacaagcaaaggcaactagagaggcacaaaaacgcactgcagccggtattatgaaaaacccgacagtggatggaatcacagtgatcgacctggaacccatctcctatgatcccaaattcgaaaaacaattgggccaagtcatgctcctggttctgtgcgccggccagttacttctaatgaggacaacatgggcattctgcgaggttctaacgcttgcaactggcccgatcctaaccctgtgggaaggaaacccgggaaggttctggaacacaacaatcgccgtatcgacggcaaacatcttccgaggatcatacctagcaggagccggcctagccttttcgctcatcaaaaatgcccaaacaccccgaaggggcacagggacgaccggagaaaccctgggggaaaaatggaagcggcagcttaactcgctcgacaggaaagagttcgaagagtacaaacgatccgggatcttggaggtcgaccggaccgaagctaagagcgccctaaaagacggttccaagatcaagcacgcagtctcgcgcggctcaagcaagatcaggtggatcgtcgaaagaggcatggtgaagcccaaagggaaagtggtagatcttgggtgcggaagaggcggttggagctactacatggcaactctcaaaaacgtaaccgaagtgaaggggtacacaaagggaggacccggacatgaggaaccaattccaatggcaacctacggatggaacctggtaaaactccacagcggggtggatgtattttacaaaccaactgaacaagtcgataccctactctgtgacatcggagaaagcagcagcaacccaacaatcgaagaagggcgaacactacgcgtattaaaaatggtagagccatggctgtcctcaaagcccgagttctgcataaaggttctcaacccatacatgccgacggtgattgaggagcttgagaagctacagcgcaagcatggcggcaacctagttcgctgcccgttatcgcggaatagcacgcacgaaatgtattgggtcagcggggcgtcagggaacatcgtctcgtccgtaaacactacatccaaaatgttactgaaccgcttcaccacaagacaccgcaagcccacatacgaaaaagacgtggacttgggggctgggacacggagcgtctccactgaaacagaaaaacccgacatgaccatcattggccgacgtcttcaacgattgcaagaggaacacaaagaaacgtggcattacgaccaagagaacccgtatcggacgtgggcgtatcacggaagctatgaagcccccagcactggcagcgctagctccatggttaacggcgtagtcaaactactgacaaaaccctgggacgtaatacccatggtaactcaacttgcaatgacagataccactccgttcggccaacaaagggtcttcaaggaaaaagtagacaccaggacaccacaaccaaaacccggcacacgtatggtgatgacaaccacagcgaattggctctgggcgctcctcggcaaaaagaagaacccgcgcctctgcacgagagaagagttcatatcgaaagtccgaagcaacgccgccataggcgcagtgttccaggaggaacagggctggacgagcgcttcggaagcggtgaatgactcacgattctgggaactggtagacaaagagcgcgctttacaccaagaaggcaaatgcgaaagctgcgtatacaacatgatgggcaagagagaaaagaagctcggcgagttcggaagggccaaaggcagcagggcaatctggtacatgtggctaggcgccagatttctggagttcgaggcactcggcttcctgaacgaggaccactggttcggcagagaaaatagctggtcgggggtcgaaggtgaaggtctacaccgactaggatatatattagaagagatcgataagaaagatggtgacctaatgtacgcagacgacacagcaggctgggatactcggatcaccgaagacgacctacaaaacgaggagcttatcacagaacaaatggcaccccatcacaagatcctcgctaaagccatattcaagctgacctatcaaaacaaggtagtcaaagtattacgacccacaccccgcggggcagtaatggatataatcagcaggaaagatcaacgaggaagcggacaagttggtacatatggtctaaacacgttcacaaacatggaggtccagctaatacgccagatggaggctgaaggtgtgatcactcaagacgatatgcaaaacccaaaaggactaaaggaaagagtagaaaaatggctcagggagtgcggcgtcgacagacttaaacggatggccatcagcggagacgactgcgtcgtcaagccactagatgaacggttcgggacatccctcctgtttctaaacgatatgggcaaagtccgaaaagacattccccaatgggagccatcaaaaggatggaaaaactggcaagaagtacctttctgtagccaccacttccacaaaatctttatgaaggatgggcgatccttagtagtgccgtgccgaaatcaagacgagctgatcggtcgcgcacgcatatcccaaggtgcagggtggtcactccgtgagacggcatgcctcggtaaagcgtatgcgcaaatgtggagcctcatgtatttccatcgcagggacctacgcctcgcatcgatggcaatttgcagcgccgtacccaccgaatggttcccaacgagcagaacgacgtggagtatccatgcccatcaccaatggatgaccaccgaggacatgctgaaagtctggaaccgagtgtggatagaggacaaccctaatatgatagacaagacaccggtgcatagctgggaagacatcccctacctgggaaagcgagaagacctgtggtgcgggagcctgataggtctctcctcaagagcaacctgggcgaagaacatacatacagccatcactcaggtgcgaaacctaatagggaaagaagaatacgtcgactacatgcctgtaatgaaacgatactccgctccctcggaatccgaaggagtactgtaa

SEQ ID NO: 26259 - RNA, 9867 nt, synthetic construct
  misc_feature 1..9867: note = derived and/or modified CDS sequence (opt11) from DENV-4__FJ182016__SS-prME
  source 1..9867: mol_type = other RNA
tccacgattacgctgctctgtcttatccccacggtgatggccttccacctgtccactcgcgacggggagcctctcatgatcgtcgccaagcatgagcgggggcgccccttactgttcaagactacggaaggcatcaacaagtgcacactcatagcgatggacctgggggagatgtgcgaggacaccgtgacctacaagtgtcctctgctcgtaaacaccgagcctgaggacatagactgctggtgcaacctgacgtccacttgggtcatgtacggaacctgtacccagtccggagaacggaggcgggagaaacgcagcgtggccctgacgccccactcgggcatgggcctcgagacacgggccgagacttggatgagctccgaaggggcctggaaacacgcccagcgcgtggaaagctggatcctacgcaaccccggcttcgctctgctcgctgggttcatggcatacatgatcggccaaacaggaatccagagaacggtcttcttcgtgctgatgatgctggtggcgccctcctacggcatgcggtgcgtcggcgtgggcaaccgggacttcgtcgagggcgtcagtggaggtgcgtgggtggacctcgttttagagcacggggggtgcgtcaccacaatggcccagggcaaaccgacgctggatttcgagctcactaagacgaccgccaaggaggtggctctcctccggacttattgtatcgaggccttgatatccaacatcacaaccgcaacccgctgccctacgcagggagagccttacttaaaagaggagcaagatcagcaatacatctgccggcgggacgtcgtcgaccggggctggggtaacggctgtggcctgtttgggaaaggaggggtagtgacttgtgccaagttcagctgttccggcaaaatcaccgggaacctcgtacaaatagaaaacctagagtacaccgtggtggtcacggtgcacaatggcgatacccacgccgtcgggaacgatactagcaaccacggggttaccgccaccatcacgcctcgctcccccagcgtggaggtgaagctgcccgactatggggagttaactctggactgcgagccccgttccgggattgacttcaacgagatgatcctgatgaagatgaagaagaagacctggctcgttcacaagcagtggtttttagacctgcccttaccctggacaactggcgctgacactagcgaggtacactggaactacaaggagcgcatggtcacgttcaaggtgccacatgcgaagagacaggacgtgacggtcttagggtcccaggagggcgccatgcacagcgccctggctggagccaccgaggtagactctggggacgggaaccacatgttcgcggggcacctcaaatgcaaggtccgcatggagaagctaagaatcaagggtatgtcctacacgatgtgctcagggaagttttccatcgacaaggagatggccgagacccagcacgggacgaccgtagtgaaggttaagtacgagggagccggggccccctgcaaggttcccatcgaaattagggacgtgaacaaagagaaggtggtcgggagggtgatatcggcaacgccattagcggagaacaccaacagtgtaaccaatatcgagttagaaccacccttcggggactcatacatcgtcatcggcgtgggcaactccgccctgacccttcattggtttcggaagggttcgtccatcgggaagatgttcgagtctacatatcgaggggccaagcgaatggccatactcggtgagaccgcatgggattttgggtccgtgggcggccttttcaccagtctcgggaaggcggttcaccaggtgttcggttcagtctacaccacaatgtttgggggcgttagctggatgatacgaatcctcatcgggttcctggtgctttggatcggaaccaactctcggaacaccagcatggccatgacctgcattgccgtgggtggcatcacgctgttcctcggctttacagtccaggccgacatgggatgtgtagttagttggagtggacgcgaactgaagtgtggttccgggattttcgtcgtggacaacgtccacacctggaccgagcaatacaaattccaaccagaaagccccgcgcggctggctagcgccatcctcaatgctcacaaagacggggtctgcgggatacgttccacgactcggttagagaacgtgatgtggaaacaaatcaccaacgagttaaactacgtgctgtgggaaggcgggcacgacctgaccgtcgtggccggggacgtgaagggagtcttaacgaaggggaaacgtgctctcactccgccggcctcagacttaaaatactcttggaaaacctggggcaaagccaagatatttaccccagaggcacgcaactcgactttcctaattgacgggccagacacctccgagtgccccaacgagcgccgtgcatggaactcgttcgaggtggaagactatggcttcggtatgttcaccacaaatatctggatgaaattccgcgagggttctagcgaggtgtgtgaccaccgcttgatgtcggcggccataaaagaccagaaggccgttcatgccgatatggggtactggatagagtcctcaaagaaccaaacgtggcaaattgagcgcgcgagcctgatcgaagtgaagacctgcttatggcccaaaacccataccctttggtccaacggggtcctcgagagccagatgttaatccccaagagttacgccggcccgttcagccagcacaactaccggcaggggtacgcaactcaaaccgtggggccctggcacctcgggaagctagagatcgactttggcgaatgccccggcaccaccgtaaccatccaggagaactgcgaccaccgcgggccctccctgagaacgacgaccgcctctggaaagctcgtaacccagtggtgctgccgtagctgcacgatgccgccccttaggttcctgggggaagacggctgctggtacggtatggagataaggccactctcagagaaggaagagaatatggtaaagtctcaggtgaccgctggtcaaggtaccagtgagacattcagtatggggcttctatgcctcaccctgttcgtcgaagagtgtctcagacggcgggtcacccgaaagcacatgatcctcgcggtggtcatcacactctgcgccatcatcctgggcgggctcacatggatggacctgctgcgagcgctgatcatgctgggagacacgatgtccgggcggatcgggggccagacccacctggccatcatggcagtgttcaagatgagcccggggtacgtgctcggcgtttttctgcgcaagctgacctctcgcgagaccgcgctcatggtcatcgggatggcaatgacgaccaccctgtcaatcccacacgatttaatggaacttatcgatggcatcagtctgggtctcatcttactcaagattgtgacccagttcgacaatacccaggtcgggaccctggctctctctttgacctttatacgctccactatgtcactggtgatggcctggcggacgatcatggccgtcctcttcgtcgtgaccttaatcccgctgtgcaggacctcgtgcctccaaaagcagtcccactgggtggagatcaccgctctgatactgggcgcccaggcgctgccggtctacctgatgacgctaatgaagggggcgtcccggcgcagctggccactaaacgagggaatcatggcggtgggtctggtgtccctgctcggcagcgccctgctgaagaacgacgttccgcttgccggacctatggttgcaggcggccttcttctcgcagcctacgtgatgtctggctcatccgccgacctgtccctggagaaggcagctaacgtacagtgggacgagatggctgacatcaccggaagctcccccatcattgaggtgaaacaggacgaggatgggtccttctccatccgggacgtggaggaaaccaacatgatcaccctcctggtcaagctggcgctaattacggtgagcggactgtatcctcttgccatcccgatcaccatgaccctctggtacatgtggcaggtgaagacccagcgatccggtgccctgtgggacgtcccctcacccgccgccacccagaaggcggccctgtcggagggggtctaccggatcatgcagagggggctcttcgggaagactcaagtgggcgtcgggatccacatggagggcgttttccacactatgtggcatgttacccgaggctccgtaatctgccacgaaaccggccggctcgagcccagttgggccgacgtgcgcaacgacatgatcagctacggcggtggctggcgcctgggcgacaagtgggataaggaggaggacgtgcaggttctcgccatcgaaccggggaagaatcctaagcacgtgcagacgaagcccggccttttcaaaaccctgacgggagagatcggcgccgtaacccttgacttcaagcctggaacttcggggagcccgatcatcaaccgcaagggcaaagtgatcggcctatacggtaatggagtggtaaccaagtcaggcgactacgtttcggcaattacccaggccgagcgcattggggagcccgattacgaggtggatgaggacatcttccgcaaaaaacgccttacaattatggacctgcacccgggcgctggcaagacgaaaagaatcttaccgagcatcgtgcgtgaggctcttaagcgcaggctgcgcaccctcatcttagcacccacacgggtcgttgccgccgagatggaagaggcgctccgggggctccccatccggtaccagacgccggcagtgaagagcgagcacacaggccgagagatcgtcgacctgatgtgccacgcgacattcaccacccggctgctctcctccacgcgcgtgcccaattacaatttgatcgtgatggatgaggcccacttcacagaccccagctcagtcgccgcgaggggatatatcagcacgagagtggaaatgggcgaggcggcggctattttcatgaccgccacgccgcccggggccactgaccctttcccgcagtcgaacagccccatcgaggacatcgagcgggagatacccgagcgctcctggaatacgggcttcgactggatcaccgactaccagggcaagacggtatggttcgttcctagtatcaaggccgggaacgatatcgcgaactgtctacgtaaatcaggcaagaaggtgatacagctcagtaggaagactttcgacaccgagtatccgaagaccaagctaactgactgggatttcgtggtgaccaccgacatctccgagatgggggccaacttccgcgccgggcgggtcatagacccccgccggtgcctgaagcccgtaatcctcaccgacggcccggagcgcgttatcctggccggcccgattccagtgacgccagcgtcagccgcccagcgacgcggccgaatagggaggaacccggcccaggaggatgatcagtacgtattctccggcgaccccctgaagaacgacgaggaccacgcccactggaccgaggcgaagatgctactggacaacatctacacacctgagggaatcatccccactctgttcggcccggagagagaaaagacgcaggcaattgacggcgagttccgcctacgcggcgaacaacgtaagaccttcgtggagctgatgcgtcggggcgacctccccgtatggctcagttataaggtcgcgtcagccgggatcagctacaaggatcgagaatggtgtttcaccggagagcgcaataaccagattctagaggagaacatggaagtggagatatggacccgggagggtgagaagaagaagctgcgccccaaatggctagacgcaagggtctacgcggatcccatggcgttgaaggacttcaaggagttcgcctccgggcgcaagtcgatcacactggatattttaactgagatcgccagtctaccaacctacctgtcatcccgcgccaagctcgcgctcgacaacatcgtaatgctccacaccaccgagcggggcgggcgggcctaccaacacgctctcaacgagctgcccgaaagcctggagactctcatgctagtggccctgctcggcgcgatgaccgccggcatcttcttatttttcatgcagggcaagggcatcggcaagctgagcatggggttgatcaccatcgccgtggcgtcaggcttgttgtgggtggccgaaatccaaccacagtggatagcggccagcatcatcctggagttcttcctgatggtgctgttgatcccggaaccagagaagcagcggactccccaggacaaccagctgatctacgtgatcctgacgatcctcaccatcataggcctgatcgccgcgaatgagatgggtctgatagagaagaccaagaccgacttcggcttctaccaggttaagactgaaacaaccatcctcgacgttgacctgaggcccgcctccgcatggacgctgtacgccgtggccacgacaatcctgactccgatgctgagacataccatagagaacacttcggccaacctatcgctagcagccatcgcaaaccaggccgcggtgctgatgggtttaggcaaaggctggcccctccaccggatggacctgggggtgcctctgctcgccatgggttgctactcacaggttaacccaaccacacttactgcatccctggttatgctactggtgcactacgctatcatcgggccaggcctgcaggctaaggccactagagaggctcagaagcgcaccgcagccggtattatgaaaaaccccaccgtggacgggatcaccgtcatcgacctcgagcctatcagctacgatcctaagtttgaaaagcagctgggccaggtcatgctgttggtgctgtgcgccgggcagcttcttctcatgagaacgacctgggccttctgcgaggtactgaccttagcgaccggtccgattttaaccctctgggaaggtaaccctggtcgtttttggaatacgacgatcgccgtgtcgaccgccaacatctttagaggcagctacctcgcgggggcaggcctggcattttcgctgataaagaacgcccagacgccgcgccggggaaccggaactaccggcgagaccctcggcgaaaagtggaagaggcagctgaatagcctggaccggaaggagtttgaagaatacaagaggtcgggcatcctcgaagttgaccggaccgaggccaaatcagccctcaaagacgggtccaagatcaagcacgccgtcagccgcggatcatcaaagatacggtggatagtagagcgaggcatggtgaagcccaaaggcaaagtcgtggatctggggtgcggccgcggtgggtggtcttactacatggcaaccctcaagaacgtgaccgaggtccggggatacactaagggtggcccggggcatgaagagcccatccctatggcgacgtatggctggaacttggtgaaactgcatagcggcgtcgacgtcttctacaagcccaccgagcaagtcgataccctcctatgtgacatcggagaaagctctagcaacccgaccatcgaggaagggcgcacgctgcgggtgctaaagatggtcgagccctggctgtccagtaagcccgaattctgcataaaagtgctgaacccttacatgccgactgtgatcgaagagctagagaagttgcaacgcaagcacgggggcaacctagtccggtgccccctttcccgcaacagcacccacgagatgtactgggtgagtggcgcgagcgggaacattgtcagctcagtgaacaccacttccaagatgctcctgaaccggttcaccacccgacaccggaaacccacctacgaaaaagacgtggacctgggcgcgggcacgagatcagtctccaccgagaccgagaagcctgatatgactatcataggccggcgactccagcggttacaggaggagcacaaggagacgtggcactacgaccaggagaacccgtatcgcacctgggcataccacgggagctatgaagccccctccaccggcagcgcatcctctatggtgaacggcgtggtcaagctgctcaccaagccctgggatgtaatccctatggtgacgcagctggccatgacagacaccacccccttcgggcagcaacgggtattcaaggagaaggtagacacccgcacaccccagccgaaaccaggcacccggatggtaatgacgacgaccgccaactggctttgggcgttactcggcaaaaagaagaacccgcggctgtgtacccgggaggaattcattagcaaggtacggtccaacgccgccatcggcgccgtgttccaggaggagcaggggtggacaagcgcatccgaagcggtaaacgacagccgcttctgggagcttgtcgataaggaacgggcgctgcaccaagagggcaagtgcgagtcgtgcgtgtataatatgatgggcaagcgagagaagaagttgggggaattcggccgcgccaaggggagccgcgctatctggtacatgtggctcggggccaggttcttggaattcgaggcgttagggttcctcaatgaggaccattggtttggacgcgagaattcctggtctggggtcgagggcgagggcctgcaccggttagggtacatactcgaggagatcgacaagaaggacggggatctgatgtatgctgacgatacggcgggttgggacacccgcatcaccgaagacgacttacagaacgaggagctaatcaccgaacagatggccccccaccataagatcctcgcgaaggccatcttcaaattgacctaccagaataaggtggttaaggtactccggccgaccccgcgcggggccgtcatggacattatctcccgtaaggaccagcgggggtctgggcaggttggaacctacggcctgaacaccttcactaacatggaggttcagctgatccgccagatggaggccgagggcgtcataacgcaggacgacatgcagaaccccaagggactgaaggagagggttgagaaatggctacgtgagtgcggcgtggaccgcttgaagcggatggccatctccggcgacgactgcgtagtgaagcccctggacgagcgattcggaaccagcctgttattcctcaacgacatgggcaaggttcgtaaggatatcccccagtgggagccgtccaaagggtggaagaattggcaagaagtccccttctgcagccaccacttccatagaattttcatgaaggacggccggtccttagttgtgccctgccgcaaccaggatgagctcatcggccgcgcgcggatcagccagggggccggctggagtcttcgggaaaccgcctgcctggggaaggcatacgcccagatgtggagcctgatgtacttccatagacgtgatttacgactggcgtctatggcaatctgcagcgccgtccccaccgagtggttccccacaagccgaacaacgtggagtattcacgcccatcaccagtggatgacaacggaggacatgcttaaggtttggaaccgggtgtggattgaggacaatcccaacatgatcgacaagacgcccgtccacagctgggaggacatcccgtacctggggaagcgcgaggacctgtggtgcgggtctctgatcggactctcttcccgggccacctgggccaagaacatccatacagccatcacgcaggtccgtaacctgataggcaaggaggagtacgtggattacatgccggttatgaagcgctactctgccccttccgagagtgagggagtattgtga

SEQ ID NO: 26260 - RNA, 9867 nt, synthetic construct
  misc_feature 1..9867: note = derived and/or modified CDS sequence (opt11) from DENV-4__EU854300__SS-prME
  source 1..9867: mol_type = other RNA
agcaccattaccctgctctgcctgatccccacggtgatggcgttccacttgtccaccagggatggcgagccgctcatgatagtggcgaaacacgagcgggggagacccctgctgttcaagaccaccgagggcatcaacaagtgcacgctgatcgcgatggatctgggcgagatgtgcgaggacaccgtgacctacaagtgtcccctgctcgtgaacaccgaacccgaagacattgattgctggtgcaacctgacgagcacatgggtcatgtacggcacctgtacccagtccggggagcggcgccgggagaagcgcagcgttgccctaacgccgcactcaggcatgggcctggagacccgggccgagacgtggatgagctccgaaggggcttggaagcacgcccagagagtggaaagctggatactgcggaaccccggctttgctctgctcgcggggttcatggcctacatgatcggccagaccgggatccagcgcacggtcttcttcgtgttaatgatgctggtggccccctcctacggcatgcggtgcgtgggcgtggggaaccgcgacttcgtggagggtgtctctggaggcgcttgggtggacctcgtgctggagcacggcgggtgcgtcacgaccatggcccagggcaagcccaccctggactttgagctcacgaagaccaccgcgaaagaggtggccctgctacggacctactgcatagaggccctcatctcaaacatcacgaccgcgacccgctgccccacccagggtgagccctacctgaaggaggagcaggaccagcagtacatctgcagacgcgacgtggtggacaggggctgggggaatggctgcgggctgttcgggaagggcggggtggtgacgtgcgccaagtttagctgctccggcaagatcaccgggaacctcgtccagatcgagaatctggagtacaccgtggtggtcaccgtgcacaacggcgacacgcacgccgtgggcaacgacaccagcaaccacggggtcaccgccaccatcacgccccgctccccttcagtggaggtcaagctgccggactacggcgagctgaccctggattgcgaaccacggtccgggatcgacttcaatgagatgatcctgatgaagatgaagaagaagacctggctcgtgcacaagcagtggttcctggatttgccgttaccctggaccactggcgctgacacgagcgaagttcattggaactacaaagagcgaatggtcaccttcaaggtcccccacgcgaagcggcaggacgtgaccgtcctggggagccaggagggcgccatgcatagcgccctggccggcgccaccgaagtggacagtggcgacggcaatcatatgttcgctgggcaccttaagtgcaaggtaaggatggaaaagctgcgcatcaagggcatgtcctatacgatgtgcagcggcaagttctccatcgacaaagagatggccgagacccaacatgggaccaccgtcgtgaaggttaaatacgagggcgccggggccccgtgcaaggtacccatcgagatacgcgacgtgaacaaggagaaagtggtcggccgcgtgatcagcgcaacgccgctggccgaaaacaccaactccgtaactaacatcgagctagagccgcccttcggcgacagctacatcgtcatcggagtgggcaactccgcgctgaccctgcattggttccggaaggggtcaagtatcggcaagatgtttgagagcacgtaccgcggggctaagcggatggccatcctcggcgaaactgcatgggatttcgggagcgttggaggactgtttacctcactggggaaggccgtccaccaggtattcggctccgtgtacaccacgatgttcggaggcgtcagctggatgatccggattctcatagggttcctggtgctgtggatcgggaccaatagccggaacaccagcatggccatgacttgcatcgcagtgggggggatcacgctgttcttgggattcaccgtccaggccgacatggggtgcgtggtgagctggaacggccgcgagctgaaatgcggctcaggcatcttcgtcgtagacaacgtacacacctggaccgaacagtacaaattccagcccgagtcccccgcgcggctggccagcgccatcctcaacgcccacaaggatggcgtctgcgggattcgcagcacgacacggctcgagaacgtgatgtggaagcagataaccaacgagctcaactacgtgctgtgggagggcgggcacgacctcaccgtagtggcaggcgacgtgaaaggcgtcctaactaaagggaaacgcgcgctcaccccgcccgcatcggatctgaagtacagctggaagacctgggggaaagccaaaatcttcacccccgagacacggaattccacgtttctaatcgacgggcccgacacgagcgagtgccccaatgagcgccgggcctggaactccttcgaagtggaggactatggatttgggatgttcaccacgaatatctggatgaagttccgcgagggtagctccgaggtgtgtgaccacagattaatgtcagcagcgatcaaggatcagaaggccgtccatgccgatatgggctactggatcgagtccagcaagaaccagacctggcagatcgagcgcgcctccctaatcgaggttaagacctgcctgtggcccaaaacccacaccctctggagcaacggggtgctggagagccagatgctgatccccaagagctacgcgggcccgttctcccagcataactaccgccagggttatgccacgcagaccgtcggcccctggcacctcggcaagcttgagatcgacttcggcgagtgccccggcaccaccgtcacgatccaggaaaactgcgaccaccgtgggcccagcctgcgcacaactacggcctccggtaagctcgtgactcagtggtgttgtcggagttgcaccatgcccccactgcgcttcctgggggaggacggctgctggtatgggatggaaatccggccccttagcgaaaaggaggagaacatggtcaagtcccaggtaacggccggccagggcaccagcgagacgtttagtatggggctgctttgcctcaccctgttcgtcgaggagtgcctgcgccggcgcgtgacccggaagcacatgatactcgcagtggtgattaccctgtgcgcgatcatcctgggcggcctgacttggatggacctgctgcgggccctcatcatgctcggcgacaccatgagcggccggatcgggggacaaacgcacctggccataatggccgtgtttaagatgtcccccgggtacgtattaggcgttttcctgcgcaagctcaccagcagagagacggccctcatggtgatcgggatggcgatgaccaccaccttatccatcccgcatgacctgatggagctcatcgacggcatcagcctgggcctcatcctcctgaagatcgtgacgcagttcgacaatacacaggtcggaaccttggccctctccctgacctttatccgaagcactatgtctctggtgatggcctggcggacaatcatggccgttctcttcgtcgtcaccctgatccccctatgccgcacctcttgcctgcagaaacagagccattgggtcgagatcacggcactgatcctgggcgcgcaggccctccccgtctacctgatgaccctgatgaagggggccagccggaggtcctggcccctcaacgagggcatcatggccgttgggctggtgtctttgctcgggtccgcgctgctgaagaacgacgtcccgctcgccggccccatggtagccgggggactgctgctcgccgcttacgtcatgagcggatccagcgcggacctgagcctcgagaaggccgccaacgtccagtgggacgagatggccgacatcaccggctccagccccattatcgaggtgaagcaggatgaggacgggtcattcagcatccgggacgtggaagagaccaacatgatcacgctcctggtcaagctggcgctcataacggtgtcaggcttataccccctggcgatcccgattaccatgaccctctggtacatgtggcaggtgaagacgcaacgcagcggcgccctgtgggacgtaccctcccccgccgccactcaaaaagccgcgctgagcgagggggtgtaccggatcatgcagcgcggcctcttcgggaagacccaagtgggcgtgggtatccatatcgagggtgtgttccacaccatgtggcacgttacccggggatcagtcatctgccacgagacgggccgcctagaacccagctgggccgatgtgcgcaacgacatgatatcctatggtggtggttggcggctgggcgacaagtgggacaaggaggaggacgtgcaggtcctcgccatcgaaccagggaagaaccccaagcacgtgcaaaccaagccaggcctgttcaagaccctgaccggggagatcggcgctgtgacgctcgacttcaagcccggaaccagcggctccccgatcatcaaccgcaagggcaaggtcattgggctgtacggcaacggggtggtgactaagtcgggcgactacgtcagcgccattacccaggcggaaaggatcggcgagcccgattacgaggtcgacgaggacatctttcgcaagaaacggctgaccatcatggacctccaccccggcgcaggcaagaccaagcgaatcctgcccagcatcgttcgggaggcactgaaacgccggctgcgcaccctcatactggcccccacccgggtagtggcggcagagatggaagaggccctgcgcgggctcccgatccggtaccagaccccagccgtcaaatccgaacacactggccgggagatcgtggacttgatgtgtcacgccacgttcaccacacggctgctgagcagtacccgcgtgccgaactacaacctgatcgtgatggatgaggcgcactttaccgaccctagcagcgtcgccgcccggggttatatttccacccgcgttgagatgggcgaagccgcagcgatcttcatgacggcaacccccccaggggccaccgacccgttcccccaaagcaattcccccatcgaggacatcgagcgggagatcccggagcgcagctggaacaccggcttcgactggatcacggactatcagggaaagaccgtctggtttgtgccgtccatcaaagctggcaacgacatcgccaactgcctgcgcaagagcggcaagaaggtgatccagctctcccggaagaccttcgacactgagtaccccaagacgaagcttaccgactgggacttcgtggttaccaccgatatcagcgagatgggcgcaaactttcgggccggacgtgtcatcgaccctcgccggtgccttaaaccagtcatcctcacggatgggcccgagcgcgtgatcctggccggccctatcccggtgactcccgcctccgcggcccagcggcgcggacggattgggcgcaacctggcccaggaggacgatcaatacgtcttctcaggcgacccgctcaaaaacgatgaggaccacgcccactggaccgaggccaagatgcttctagacaacatctacacccccgaggggattatccccacgctctttggccccgagcgggagaagacccaggcgatcgatggcgagttccgcttgcggggtgagcaacgcaagacgttcgtggagctgatgcggcgcggcgacttaccggtttggctgtcctacaaagttgcctcagccggcatcagctacaaggaccgtgagtggtgcttcaccggcgaacgcaacaaccagattctggaagaaaatatggaggtcgagatctggacccgggagggagagaagaagaagttgcgccccaagtggctagatgccagggtgtacgccgacccaatggcgctgaaggacttcaaggagttcgccagcggccgtaagtccataacgctcgacatcctgacagagattgccagcttgcccacctacctctccagccgcgccaaactggcgctggataacatcgtcatgttgcacaccacggagcggggggggagagcatatcagcacgccctcaacgagctgccggagtccctcgagacactgatgttggtggccctgctgggcgccatgaccgcggggatatttctgttcttcatgcagggcaagggcatcggcaagttgagcatgggcctgatcacaatagccgttgcctcggggctgctctgggtcgccgagatccagcctcagtggatcgcggcgtcgatcatactggaatttttcttgatggtgctactgatacccgagccggagaaacagaggactccccaggacaaccagctgatttacgttatcctcactatactgaccatcatcggtctgatagccgccaacgaaatggggctcatcgagaagaccaaggccgacttcggcttctatcaggtcaagacggagaccaccattctagacgtagacttacgacccgccagcgcgtggacgctctacgccgtggccacgaccatcctgacccccatgctgagacacaccatcgagaatacgagcgccaatctcagcctggcggcgatcgccaatcaggccgccgtcctgatggggctcggcaagggctggccgctgcatcgcatggatctgggggtgccgctcctggctatgggctgctactcccaggtgaaccccaccaccctgaccgccagcctcgtcatgctgctggtgcactacgctatcatcgggcccggcctgcaggccaaggccacgcgggaggcgcagaagagaaccgccgccggcataatgaagaacccgaccgtggatggcatcacggtcatcgacctggagcccatctcatacgaccccaagttcgagaagcagctgggccaggtgatgctcctggtgctgtgcgccgggcagctcttgctaatgcggacaacctgggccttctgcgaggtcctcactctggcgactggccccatactgacgctctgggaagggaacccgggtcgtttctggaacacaaccatcgccgtgagcaccgcaaacatcttccggggctcctacctggccggggccggcctggcgtttagcctcatcaaaaacgcccagacgcctcgccgggggaccggcactaccggggagaccctgggcgagaagtggaagcgccagctgaactcccttgaccgtaaggagttcgaggagtataagcgctccggcatcctggaggtggaccggacagaggccaagagcgccctgaaggatgggagcaagattaagcacgccgtctcccgcggcagctccaaaatccggtggatcgtggagagagggatggtgaagcccaagggcaaggtcgtagacctcgggtgcggccgcggcggctggagctactacatggcgactctgaagaatgtgacagaggtcaagggatacaccaagggcggccccgggcacgaggagcctatccccatggccacctacggatggaacctggtcaagttgcactccggagtggacgttttctacaagcccaccgagcaggtggacaccctgctgtgcgacatcggagagagcagctccaatcccaccatagaggagggccggacgctccgcgtgcttaaaatggtcgaaccgtggttgagcagtaagcctgagttctgcatcaaggtgctgaacccctacatgcccaccgtcatcgaggaactcgagaagctgcagcggaagcacggaggcaacctggtccgctgcccgctcagccggaactccactcacgagatgtactgggtcagcggcgcctccggcaacatcgtcagcagcgtcaacaccacgagcaagatgcttctgaaccgctttaccactcggcaccgcaagcccacttacgaaaaggacgtggacctgggcgcagggacacggtccgtcagcacggaaaccgagaagcccgatatgaccatcattggccgccggctccaacggctgcaagaggagcacaaggagacgtggcactacgaccaggagaacccctatcggacctgggcgtaccacgggtcctatgaggccccctcgaccggctccgccagttcaatggtcaacggagtggtcaagctcctgaccaaaccttgggacgtcatccccatggtcacgcagctggccatgacggacaccacaccgtttgggcaacagcgcgtcttcaaggaaaaggtggatacacggaccccccagcccaaacccggcacgcgcatggtgatgaccacgaccgctaactggttgtgggcgctgctggggaagaagaaaaacccgcggctctgcactcgcgaggagttcatctcaaaggtgaggtccaacgccgccataggcgccgtgttccaggaggagcaggggtggaccagtgccagcgaggccgtgaatgactcccgcttctgggagctggtcgacaaggaacgggccctgcatcaggagggtaagtgcgagagctgcgtgtataatatgatgggcaagcgcgagaagaaactaggggaattcggccgcgccaaggggtcccgggccatctggtacatgtggctgggcgcccgcttcctggagttcgaggccctcgggttcctgaacgaggaccattggttcgggcgggagaacagctggtccggcgtggagggggaaggcttacaccgactcgggtacatcctggaggaaatagacaagaaagacggcgacctgatgtatgccgacgacactgccggctgggacacccggatcaccgaggacgacctccagaacgaggagctgatcactgagcagatggctccccaccacaagattttggccaaggccatattcaagctcacgtaccagaacaaggtcgtgaaggtgctgcgccccacgccccgtggggccgtcatggacatcatcagccgcaaggaccaacggggctccgggcaggtgggcacctatgggctgaacaccttcaccaacatggaggtgcagttgatacgtcagatggaagccgaaggcgtcatcacgcaggacgacatgcaaaacccaaagggtctgaaagagcgagtggagaagtggctacgcgagtgtggcgtagaccgactcaagcgcatggcgatcagcggcgacgactgcgtagtgaaaccgctggatgagcggttcgggacctccctgctctttctgaacgatatgggtaaagtgcgcaaggacatcccacaatgggagcccagtaaggggtggaagaactggcaggaggtccccttttgcagtcaccacttccacaagatcttcatgaaggacggccggtcgctagtggtgccgtgccggaaccaggacgaactcatcggccgggcgcgcatttcgcagggggccgggtggagcctgcgcgagaccgcctgcctggggaaggcttatgcccaaatgtggtccctcatgtacttccaccggcgcgacctgcggctggcctctatggccatctgctccgccgtgcccacagagtggttccccacgtcgcgcacaacgtggagcatccacgcccaccaccagtggatgaccacggaggatatgctcaaggtatggaaccgcgtgtggatagaggacaacccgaacatgatcgacaagacccccgtccactcgtgggaggacatcccctacctgggcaagcgcgaggacctgtggtgcgggagcctcatcggcctgtccagcagggccacctgggcgaagaacatacacaccgccattacgcaggtgcgcaacctgatcggcaaggaggagtacgtcgactacatgcccgtcatgaaaagatactccgcccccagcgaatccgagggagtgctctga

SEQ ID NO: 26261 - RNA, 9867 nt, synthetic construct
  misc_feature 1..9867: note = derived and/or modified CDS sequence (opt11) from DENV-4__FJ182017__SS-prME
  source 1..9867: mol_type = other RNA
agtaccataacactcctctgcttaatccctacggtaatggccttccatctctccacccgcgacggcgagccgttgatgatcgtcgccaagcatgagcgtggtcgcccactgctgttcaagaccaccgagggcatcaacaagtgtaccttgatagcgatggacctcggggagatgtgcgaggacactgtgacctataagtgccctctactcgtgaataccgagcccgaagacatagactgctggtgcaacctcacgtccgcctgggtcatgtacggcacctgcacccaaagtggggaacggaggcgtgagaagcgcagcgtggccctgaccccgcacagtgggatgggcctcgagactcgggcggagacgtggatgtcgagtgaaggagcctggaagcatgcgcagcgagtggaaagctggatcctccggaaccctggcttcgcactgctcgccggcttcatggcgtatatgattggccagaccgggatccaacgcactgtcttcttcgtattaatgatgttagtagctccatcgtacggcatgcggtgcgtcggcgtggggaacagagacttcgtggaaggcgtctctgggggcgcctgggtggacctcgtcctggagcacggcggttgcgtcacgaccatggcccagggcaaacccaccctggactttgagttgacaaagactactgccaaggaggtggctttactgcggacttactgcatagaggcgctcatatccaatattaccacagccacgcgctgcccgactcaaggggagccctacctgaaggaggagcaggaccaacagtacatctgccgtcgtgacgtagtagaccggggctgggggaacggctgtggtctgttcgggaagggcggggtcgttacctgcgccaagttcagctgcagcggtaagatcacgggcaacctcgtccagatcgagaatctggagtacaccgtcgtggttactgtgcacaatggcgatacccacgccgtcggcaacgacacgagcaatcacggggtgaccgccaccatcacccccaggtccccctccgtggaagtcaagctgccggattacggcgaactcacgttagactgcgagcctaggtctgggatcgactttaacgagatgatcctgatgaagatgaagaagaagacgtggctcgtgcacaagcaatggtttctagacctgcccctgccgtggaccaccggcgcggacacgtcggaggttcattggaattacaaggagcgcatggttacattcaaggtcccccacgctaagcgacaggacgtcaccgtgctgggctcccaggagggcgccatgcacagcgccctggccggcgcgaccgaggtcgactccggggacggcaaccacatgtttgccgggcacctcaagtgtaaagtacgcatggagaagctgagaatcaagggcatgagctataccatgtgtagcggcaagttctccatagacaaggagatggccgagacgcagcacgggaccaccgtcgtgaaggtgaagtacgaaggcgccggggctccctgcaaggtccccatcgaaatccgggacgtgaacaaggagaaagtggtaggccgcgtgatttcggccacccctctggcagagaacacgaattcggtgactaacatcgaattggagccgccattcggggacagctatattgttatcggtgtggggaactccgccctaacgctgcactggttccgcaaggggagctccattggcaagatgttcgagagcacgtaccgcggggccaagcggatggcaatcctcggcgagacggcctgggacttcgggtcagttggtgggctgttcacaagcctgggcaaggccgtccaccaagtgttcggcagtgtctataccactatgttcggcggcgtaagctggatgattcgcatcctcatcggcttcctggtcctgtggatcggcacgaactccaggaacacctcgatggccatgacctgcattgctgtgggtgggatcaccctgttcttgggcttcacggtccaggcggacatgggctgcgtggtctcctggagcggccgtgagctgaaatgtgggagtggtatctttgtggtggacaacgtgcatacctggactgagcaatacaagttccagcccgagagccctgcccggctggccagcgctattctcaacgcccacaaggacggcgtctgtggcattcgctccaccacccggctggagaacgtgatgtggaagcagatcaccaacgagctgaattacgtgctatgggagggcgggcacgacctgaccgttgtggctggagacgtaaagggcgtcttaacaaaggggaagcgcgccctcacgccgccagcgagcgacttgaaatactcttggaaaacctgggggaaagccaagatttttactcctgaggcccggaatagcactttcctgatcgacggccctgacacgtcagagtgcccgaacgagcgtcgcgcatggaacagctttgaagtagaggattatggcttcggcatgtttactaccaacatctggatgaaattcagggagggctccagcgaggtgtgtgatcaccgcctcatgtccgccgccataaaggatcaaaaggccgtgcacgcggacatgggctactggatcgagtcatccaagaaccagacctggcagatcgagagagccagcctgatcgaagtgaaaacgtgtttatggcccaagacccacaccctctggtctaatggagtgctggagagccagatgctgatccccaaatcctacgccggaccgttcagccagcacaactaccgccaggggtatgccacccagaccgtcggcccctggcacctcggcaagcttgagatcgacttcggagaatgccccggcacgaccgtgacaatacaagagaattgtgaccacagagggccgtctctgcgtaccacgaccgcgtctggcaagttagtgacgcagtggtgctgtcgaagctgcaccatgccgcccctgcgcttcctgggtgaagacggctgctggtatgggatggagatccgacctctgagtgagaaagaggagaacatggtcaagagtcaggtcactgcgggccaaggcaccagtgagacctttagcatgggactgctgtgccttaccttgttcgtcgaggagtgtctccgacggcgtgtaacgcggaaacacatgatacttgccgtggtcataacactttgcgccatcatcctgggcgggctcacctggatggacctgctccgagccctcatcatgctgggtgacaccatgtccggccggattgggggccagacgcaccttgccattatggcagtattcaagatgagtcccgggtacgtgctcggagttttcctgcgcaagctcaccagccgagaaaccgccctcatggtgatcgggatggccatgacaacgactctcagcatcccgcacgacctaatggagctcatagacggcatatccctcggcctaatcttgctgaagatcgtaacccagttcgacaacacccaagtcggaacgctggccctctctcttacttttattcgctctaccatgagcctggtgatggcctggcggaccatcatggcggtgctcttcgtcgtaaccctgatccccttatgccgcacctcctgccttcaaaagcagagccactgggtggagataaccgccttaatcttgggcgcccaggccctccccgtgtatcttatgaccctgatgaagggggccagtcggcgctcctggcctctgaacgagggaatcatggccgtggggttggtctccctgctcggctccgccctgttgaagaacgatgttccgcttgccggacccatggtcgccgggggtctgcttttggcggcctacgtgatgtctgggagctcggccgacttgtcactggagaaggctgctaacgtccaatgggacgagatggcggacattacgggcagctccccgatcatcgaggtgaaacaggatgaggacgggagcttctccatccgggacgtggaggaaaccaatatgatcaccctcctggtcaagctggccctaataaccgtgagtggcttataccccctggcaatccctattacgatgaccctctggtacatgtggcaggttaagactcaacgctccggcgctctgtgggacgtcccctcgcccgctgcgacccaaaaggccgcactgtccgagggggtgtaccggattatgcagcgcgggctttttgggaagacgcaggtcggcgtcgggatacacatggagggggtgttccacacgatgtggcacgtgacccggggctctgtaatttgccatgagaccggccgcctggagcccagttgggcagacgtgcgaaacgacatgataagctatggaggcggatggcggctgggcgacaagtgggacaaggaggaggacgtgcaggtcctcgccatcgagccgggcaagaaccccaagcatgtgcaaaccaagcccggcctgttcaagaccctgaccggggagattggggcggtaaccctcgatttcaaacccgggacttccggcagcccgattatcaaccgcaagggcaaggtaatcgggctgtacggcaacggcgtggtgacgaagtccggcgattacgtgagcgccatcacacaggccgagagaatcggggagcccgactatgaggtagacgaggacatcttccgcaaaaagcggctaacgatcatggatctccacccaggcgccggtaagacaaagcgcattctgccctccatcgtgcgggaggcgctgaagcgccggctacgcacactcattctggctcccactcgggtcgtggcagccgaaatggaggaggccctgcgcgggttgcccatccggtaccagacgcccgcggttaagagcgagcacaccgggcgcgagatcgtcgacctgatgtgccacgccaccttcaccacccggctgctctccagcacccgcgtaccgaactacaatctcatagttatggacgaggcccatttcacggaccccagctccgtcgccgctcgtgggtacataagcacccgggtggagatgggcgaggcggccgcgatcttcatgacagccaccccccccggggctacggacccattcccgcagtccaacagccccatcgaggacattgagagggaaatccccgagcgctcctggaacaccggcttcgactggatcaccgactaccaaggcaagacggtctggttcgtgccgagcataaaagcggggaacgacatcgccaactgcctgcgcaagtccgggaagaaggtcatacagctttcccggaagacgttcgacaccgagtatccaaagaccaaactgacggattgggacttcgtcgtgacgaccgatatctccgagatgggggccaatttccgggccggacgggtaatcgacccgcgccggtgcctcaaaccggtcatactaaccgatggtccagagcgcgttatccttgcgggcccgattcccgtgacacccgccagcgccgcgcaacggcgcggacggatcggtcggaacccggcccaggaagacgaccagtacgtcttttcgggcgaccccctgaagaacgacgaggaccatgcgcactggacggaggctaagatgctactagacaacatatacactcccgaggggattattccgactctgttcgggccggagagagagaagacacaggcgatcgacggcgagttcaggttacggggggaacagcggaagacgttcgtggagctgatgcggcggggcgacctgcctgtttggctgagctataaggtcgcgtccgccggtatcagctataaggaccgggagtggtgctttaccggcgagcgaaacaaccagatcctggaagaaaacatggaagtggagatatggacccgagagggcgaaaaaaagaagctacgccccaagtggttggatgcgcgggtgtacgccgaccccatggccttgaaagacttcaaggagttcgcttccggtcgcaagagcatcactctggacatcctcactgagatcgcctcccttccaacgtacttgagctcccgcgcaaagttagccctggacaacatcgtaatgctgcacactaccgagcggggtgggcgcgcctatcagcatgccctcaacgagcttcccgagagcctggagacgctcatgctcgtggcgctactcggagccatgacagccggaatcttcctattcttcatgcagggcaaggggatcgggaagctgagtatggggctcatcacaatcgccgtggcctccgggctgttgtgggtcgccgaaatccagccacagtggatcgccgccagcatcatcctcgagttctttctgatggtcctgctcattccggagcccgagaaacaaaggaccccccaggacaaccagctgatttatgttatccttaccatcctcactatcatcggtctgatcgctgccaatgagatgggcctgattgagaagacaaaaaccgacttcggtttctaccaagtgaagaccgaaacgactatcctcgacgttgatctacgccccgcgtccgcctggaccctgtacgccgtggcgactacaatcctcaccccgatgctacggcacacaatcgagaacaccagcgcaaatctgtccctggcggccattgccaaccaggcagccgtcctgatgggtctgggcaagggctggcccctccaccgcatggacttgggggtaccactgctcgctatgggttgctacagccaggttaaccctactaccctgaccgcgagtctggtcatgctcctggttcattatgccatcattgggcctggcctgcaagcgaaggcgacgcgggaggcccagaagcgcacggcggccggcatcatgaagaaccccaccgtggatgggatcaccgtcatcgatctagagcccatctcgtacgaccctaagttcgagaagcagttaggccaggtgatgctgctcgccctgtgcgcggggcagctgctcctgatgcggactacatgggcgttctgcgaggtgctgaccttggccaccggcccaatcctgaccctttgggaaggtaaccctggccgcttctggaacacgaccatcgccgtctcaaccgcaaatatattccggggctcttacctcgcgggggccggcctggcgttctccctgatcaagaatgctcagaccccccgccggggtacgggtactactggggaaaccctcggcgaaaagtggaagcgacaacttaacagcctggaccggaaagagttcgaggagtacaagcggtccggcattctcgaagtggaccggacagaagctaagtcagcgctaaaggacgggagtaaaattaagcatgccgtgtcacgcggctccagcaagatccggtggatcgtcgagcgcggtatggtgaaaccgaaagggaaggtcgtcgacctggggtgcggtaggggcgggtggtcctactacatggctacgctcaaaaacgtgacagaggtcaaaggttacaccaagggtggaccgggccatgaggagcctatcccaatggccacctacggctggaatctggtcaagctgcacagcggtgtggacgtattttacaagcccacggaacaggtcgacaccctgctgtgcgacatcggagagtcctccagcaacccaaccatcgaggaggggcggaccctgcgcgtgctaaaaatggtggagccatggctctcgagcaagcccgagttttgcatcaaggtactgaacccctacatgccaactgtgattgaggaactggaaaaactgcaacggaagcacggtggcaacctggtacgctgccctctcagccggaactcgactcacgagatgtactgggtgtccggcgccagcgggaacattgtgtccagcgtcaacaccacctccaagatgctcctgaaccgctttaccacccgtcaccgcaagcccacctacgagaaggacgtggacctgggcgcagggacccggtcagtgtccacggagactgaaaagccagacatgaccataatcggtaggcggttacaacgcctgcaggaggagcacaaagagacctggcattacgaccaggagaacccatatcggacgtgggcgtaccacgggagctacgaggcccccagcaccggttcagcctcgtcgatggtcaatggggtggtgaaacttctcacgaagccttgggacgtaattcctatggtgacccagctggcaatgaccgacaccacgcccttcgggcaacagcgcgtgttcaaagagaaagtcgatacgcgcacgcctcagccaaagccggggaccagaatggtaatgaccaccacagctaactggctgtgggccctcctggggaagaagaagaacccccggctgtgcacccgcgaagaattcatctccaaagtccggagcaatgctgcgattggcgcagtcttccaggaggagcaggggtggaccagcgcatccgaggctgttaatgacagccgtttctgggagctcgtggataaggagcgggccctgcaccaggagggcaagtgcgaatcttgtgtctacaatatgatgggcaagcgcgagaagaagcttggtgaattcggccgggccaaagggagccgggcgatatggtacatgtggctcggggcccgctttctggagtttgaggccctgggctttctcaatgaggaccactggttcggccgggaaaactcatggagcggtgtggaaggggagggcctgcaccgattggggtacatactcgaggagatcgacaagaaggacggcgacctgatgtacgccgacgacacagcgggctgggacacgcggataacagaggacgacctgcagaacgaagagctaataaccgagcagatggccccgcaccacaagatccttgccaaggccatcttcaagctgacttatcaaaacaaggtggtcaaggtgctcaggccgacaccacgcggtgccgtgatggacatcatctccagaaaagaccaacggggcagtggtcaagtagggacctatggacttaacaccttcaccaatatggaggtgcagctgatccgccagatggaggcagaaggggttatcacccaggacgacatgcagaaccccaaaggactgaaggagagagtggaaaagtggttacgcgagtgcggggtggaccgcctgaagcgtatggctatatccggagatgactgtgtggtcaaacccctcgacgagcggttcgggacgagcctgctgttcctcaatgacatgggtaaggtgcgaaaggacatcccacagtgggagccaagtaaggggtggaagaactggcaggaggtgcccttctgctcacaccacttccacaagatcttcatgaaggacggccgatccctggtcgtgccctgccgcaaccaggacgagttgataggccgggcgcgcatcagccaaggggccggctggtctctccgcgaaactgcctgcttgggaaaagcgtacgcccagatgtggagcctgatgtacttccaccggcgcgatctccgtctggcctctatggccatctgcagcgccgtacctaccgagtggtttccgacctcacgcacgacctggtctatccacgcgcatcaccaatggatgacaaccgaggacatgttgaaggtttggaaccgggtgtggatcgaagataaccccaatatgatagacaagacacccgtacacagctgggaagacatcccctacctcggaaagcgcgaggatctctggtgcgggtccctgatagggctttcctcccgggcgacctgggccaagaacatccacactgccatcacacaggtcagaaacctgatcggcaaggaggagtacgtcgattacatgcccgtgatgaagcgatacagcgccccctctgagagcgagggtgtcttatga

SEQ ID NO: 26262 - RNA, 9867 nt, synthetic construct
  misc_feature 1..9867: note = derived and/or modified CDS sequence (opt11) from DENV-4__EU854301__SS-prME
  source 1..9867: mol_type = other RNA
tcgactatcaccctgctgtgcctgattcccacggtaatggcttttcacctgtcaactcgcgatggagaaccactcatgattgtcgccaagcacgaacgggggcgccccctgctgttcaagaccaccgaaggtattaacaagtgcacgctgatcgcgatggacctcggggaaatgtgcgaggatacagtcacctataaatgccccttattagtgaataccgagcccgaggacatcgattgctggtgcaacctaacgtccacctgggtcatgtatggtacttgcacccagtccggggagaggcggcgggaaaagcgcagcgtcgcgctgaccccgcactccggtatgggcctcgaaacgcgggccgagacctggatgagctccgagggggcctggaaacacgcgcagcgcgtggaatcatggattctgaggaaccctgggttcgcgctgctcgccgggtttatggcttatatgatcggccagaccggtatccagcgcactgtcttctttgtgctgatgatgctggtagccccatcatatggcatgcggtgtgtcggcgtggggaaccgcgacttcgtagagggcgtatccgggggcgcgtgggtggacctcgtgctggaacatggcgggtgtgtcaccaccatggcccagggcaaacccaccctggacttcgagctcacgaagaccacagccaaggaggtggcgctgctgcggacatactgcatcgaggcttctataagcaacattacgaccgcgactcgctgcccgacgcaaggggaaccctacctgaaggaggagcaggaccagcagtacatatgccggagggacgttgtggaccggggctgggggaacggctgcggtcttttcgggaaaggaggggtggttacctgcgccaagttctcttgcagtggcaagatcaccgggaaccttgtccaaattgagaacctcgaatacaccgtcgtggtcacggtgcacaacggagacacgcacgcagtcggcaacgatacctccaaccatggggtgaccgcaaccatcacgccacgcagcccttctgtggaggtcaaactgcccgactatggggagctgacgttagactgtgagccccgaagcgggattgatttcaacgagatgatactgatgaagatgaagaaaaagacctggctggtgcacaagcagtggttcctcgacctgcccttgccctggaccacgggcgccgacacgtctgaggtgcactggaactacaaggaacgcatggtaaccttcaaggtacctcacgcgaagcggcaagatgtaaccgtcttgggaagccaggagggcgccatgcacagcgccctggctggggccaccgaggtggattcgggggacggaaaccacatgttcgcggggcacctgaagtgcaaggtccgcatggagaagctccgcatcaagggaatgagctatacgatgtgcagtggcaagttcagcatcgacaaggagatggccgagacccagcacgggaccactgtcgtaaaagtcaagtatgagggagccggggccccctgtaaggtcccgatcgaaatccgggacgtgaataaggagaaggtggtcggccgcgtgatttccgccacgcctcttgcagagaacaccaacagcgtgaccaacatcgagctggagccacctttcggggactcctacatcgtcattggcgtggggaacagtgccctcacgctgcactggtttcggaaggggtccagcataggcaaaatgttcgagtctacttacagaggcgcgaagcggatggccattctgggcgaaaccgcgtgggacttcgggagcgtgggcggtttgttcacgtccttagggaaggccgtgcaccaaatcttcggcagcgtgtacaccacgatgttcgggggcgtctcctggatgatccggatcctgatcgggtttcttgtcctgtggatcggcaccaactcgcggaacacctcgatggcgatgacctgcatcgccgtgggcgggatcacgctgttcctggggttcaccgtacaagccgacatggggtgcgtcgtgtcttggtcaggtcgcgaactcaagtgtggcagtggcatcttcgttgtcgacaacgtgcacacctggaccgagcagtacaagttccagcccgaaagcccagcacggttggcctcggccattctgaacgcccacaaggatggagtctgcgggatccgcagcacgacccgcctggagaatgtcatgtggaaacagataaccaacgagctgaactacgtgttgtgggaaggcgggcacgacctcaccgtagtcgcaggagatgtaaagggcgtgcttacgaaggggaagcgcgctctgaccccgcccgcttcggacctcaaatacagctggaagacctggggcaaggccaagatcttcacccccgaggcccgaaactccacgtttctaatcgacggccctgacacaagcgagtgcccgaatgagcgccgggcgtggaactcctttgaagtcgaggactacggcttcggtatgttcaccaccaatatctggatgaaatttcgggagggcagctcggaagtgtgcgatcaccgcctgatgagcgcggccatcaaggaccagaaagcggtgcacgcagatatgggctactggattgagtccagtaagaaccagacgtggcagatcgaaagagcttcccttatcgaggtcaagacctgcctgtggcccaagacccacactctgtggagcaacggggtgctagagtcacagatgctgatccccaagtcctatgccggccctttctcgcagcataactaccggcaagggtacgccacccagacggttggcccctggcacctcgggaagttagagatcgacttcggggagtgccccggaaccacagttacaatccaggagaattgcgaccaccgaggtccaagcctccgcacgactaccgccagcggtaagctggttacacaatggtgctgtcgctcctgcacgatgccgcccttgcgcttcctgggggaggacggctgctggtacgggatggagatcaggccccttagcgagaaggaggagaacatggtgaagtcccaagttaccgccggccagggcaccagcgagactttctccatgggactactgtgcctgacactatttgtggaagagtgcctccgccggcgagtcacccggaagcacatgatcctcgcggtggtcatcaccctctgcgccatcatcctgggcggtctgacttggatggaccttctgcgcgccctgattatgctcggtgacacaatgtctggccggatcgggggccagacgcaccttgccatcatggccgtcttcaagatgtcccccgggtacgtgctgggcgtattcctccgtaagctgaccagccgggagactgcgctgatggtcattggcatggccatgacgaccaccctttcgattccacacgatctgatggagcttatcgatggtatcagtctaggcctgatactgttaaagatcgtgacacaattcgataacacgcaagtcgggacacttgcgctgtccctcacattcatccgctccactatgtccctggtcatggcctggcggactatcatggcggtgctgttcgttgtgaccctcatcccattatgcagaaccagttgtcttcagaagcagtcccactgggtcgagataaccgctttaatcttgggcgcccaggctttgcccgtgtacctcatgacattgatgaagggcgcgagtcggcgcagctggcccttaaacgagggcatcatggcggtggggctcgtgagtctcctaggctccgcgctcctgaagaacgatgtgccgctggcaggaccaatggtcgcgggaggactcctgctggccgcatacgtcatgagcgggagctccgccgacttatcgctggagaaggcagccaacgtgcaatgggacgagatggccgacatcactggctccagtcccatcatcgaggttaagcaggacgaggacgggtcttttagcattcgggacgttgaggagacaaacatgatcacactgctcgtgaagctggctctgattaccgtctccggcctctacccgctggcaataccgatcaccatgacactgtggtacatgtggcaagtgaagacccaacgctctggtgccctctgggacgtgccgtcccctgccgccacccagaaggccgcgcttagcgagggggtctatcggatcatgcagcgcggattattcgggaaaacacaagtgggcgtgggcatccacatggagggcgtattccacaccatgtggcacgttactcgaggatccgttatctgccacgagaccggcaggttagaaccctcctgggccgacgtcaggaacgacatgatctcctacggcgggggctggcggcttggagacaagtgggacaaagaggaggacgtacaggttctggccatcgagccagggaaaaaccccaagcacgtccagacaaagcctggcctctttaaaacattaaccggggagatcggcgcagtaacgctggacttcaagcccgggaccagcggttcgccaatcatcaaccgcaagggcaaggtgatcggtctctatgggaatggggtcgttaccaagtccggagactacgtgtccgccatcacacaagcagaacggatcggggagccagattacgaagttgacgaggacatcttccgcaagaagcgtctgaccatcatggacctgcaccccggcgccggcaagacaaagcggatcctcccgagcatcgtgcgggaggccttaaaacgccggctgcgcaccctcatcctcgcgccgacccgggtggtggccgccgagatggaggaggccctcagggggctaccaatacgctaccagacaccagccgtgaagagtgagcacaccggccgcgaaatcgtggaccttatgtgccacgcgacgttcaccactcgattgctaagcagcactagggtccctaactacaacctaatcgtgatggatgaggctcattttacagaccctagcagcgtggccgcccggggctacatctccacgagggtggagatgggagaggccgcggccatattcatgaccgcgacgccgcccggtgccaccgacccattccctcagtcaaactcccccatagaggacatcgagcgggaaatccccgagcgatcatggaatacgggattcgactggataaccgactaccagggcaagacggtgtggttcgtccctagcattaaggcggggaacgacatcgcaaactgcctccgcaagagcgggaaaaaggtaatccagctttcccggaaaacgttcgacaccgagtaccccaagacaaagctcaccgactgggacttcgtggtcactaccgacataagcgaaatgggggctaactttcgcgccggccgggttatcgacccccgacgttgcctgaagcctgtgatcctgaccgatgggccggagcgtgttatcctcgcgggtcccattcccgttacgcctgcgtccgcggcccaacggcgcgggcgaatagggcgcaacccggcgcaagaggacgatcagtacgttttcagcggggaccccctgaagaacgacgaggaccacgcgcattggaccgaagctaaaatgctgttagacaatatctacaccccagaggggatcatccccacgctgttcggcccggaacgggagaaaactcaggccatcgacggcgagttccgcttaagaggggagcagaggaagaccttcgtcgagctcatgcggcgcggagacctgcccgtgtggttatcatacaaagtcgcaagcgcggggatcagctacaaagatcgggagtggtgcttcactggagagcgcaacaaccagatcttggaggagaacatggaagtcgagatatggacccgggagggcgagaagaagaagctgcgccccaagtggctggacgcgcgagtatacgcggaccccatggccctcaaggacttcaaggagttcgccagcggccgcaagtccatcacccttgacatcttgacggagattgcctcactcccgacttatctgtccagccgcgccaaactggcgctcgacaacatcgtgatgctccataccaccgagcggggcgggcgcgcctatcagcacgcactgaacgaactacccgagtccttggagacgctcatgcttgtcgccttactgggagcgatgacggcagggatctttctcttcttcatgcagggcaagggcatgggcaagctgtccatgggcctgattaccatcgccgtggcaagcgggctcctatgggtggcagaaatccagccccaatggatcgcagcctccatcatcctggagtttttcttgatggtccttttgatcccggagcccgagaagcaacgcacaccccaggacaaccagctgatctatgtgatcctgactatcctgaccatcataggcctcatcgccgcgaatgagatgggactgatcgagaagaccaagaccgacttcgggttctatcaggtgaaaacggagacgaccatccttgacgtggacctccgccccgcctccgcgtggaccctgtatgccgtggccacgactattctgaccccgatgctcagacatacgattgagaacacttccgccaacttatcgcttgcagcgattgccaatcaggccgccgtcctcatgggtctgggcaagggctggccgctgcatcgcatggatctcggggtccctttactggcaatgggctgctacagccaggtgaatcccaccaccctcaccgcgagcctggtgatgctcctggtccactacgccataatcggcccgggcctgcaggcaaaggccacgcgggaggcgcagaagcgcaccgccgccggaatcatgaagaatcctacagtggacgggatcaccgtcatcgacctggagcctatatcctacgaccccaagttcgaaaagcagctgggccaagtcatgctgctggtcctctgcgcggggcagctgtttctgatgcggactacctgggcattctgtgaggtgctcaccctggctaccggccccatcctgacgttatgggaggggaaccccggcaggttctggaataccacaatcgccgtgagcaccgcaaatatcttccggggaagctacctggccggagctggcctggctttcagccttatcaaaaatgcccaaacgcccagacgggggaccggtaccaccggggagaccctaggcgaaaagtggaagcgccaactgaactccctcgaccggaaggagttcgaagagtataaaagaagcggtatattggaggtcgaccggacggaggctaagtccgcgctgaaagacgggagcaaaatcaaacacgccgtcagcaggggcagctccaaaataagatggatcgtagaacggggcatggtgaagccaaagggcaaggtcgtcgatctcgggtgcggccgcggcggctggagttactacatggcgacactaaagaatgtgaccgaggtgaagggctacaccaaaggtgggccggggcacgaggagcccatccccatggccacgtatggctggaacctggtaaagctccacagcggtgtagacgtattctacaaacccaccgaacaagtagacaccctgctgtgcgacatcggggagtccagctccaatccgaccatcgaggagggtcgtactctccgagtgctaaaaatggtggagccctggctcagctcaaagcccgagttttgcattaaggtattgaacccgtatatgcctactgtcatagaggagctggagaagctgcagcggaagcacgggggcaacctggtgcgctgccccctctctcgcaactccacccatgaaatgtactgggtctctggcgccagcgggaacatcgtgtcttccgttaacactacgagcaagatgctacttaaccgcttcaccaccaggcaccgcaagcctacctacgagaaggatgtagacctcggcgccgggacacgtagtgtgagcaccgagacggagaagcccgacatgacgatcatcggacgccggctgcagcgcctgcaagaggagcacaaggaaacatggcactacgaccaagagaacccttaccgaacctgggcgtaccacgggtcctatgaggccccgagcaccggctccgcctcttcaatggtcaacggcgtggtgaagctcttaacaaagccgtgggacgtcatccctatggtgacccaactggccatgactgacaccaccccgttcgggcagcagcgtgtattcaaggaaaaggtggatacaaggactccccaaccgaaacccggcacccgcatggtgatgaccacgaccgcaaactggctctgggccctgctgggcaagaaaaagaacccacggctctgtacccgcgaagagttcatctccaaagtacggtccaacgccgctataggcgccgttttccaggaggagcagggttggacctccgctagcgaggcggtgaatgactcccgcttctgggagctggtggacaaagagcgggcgctgcaccaggagggaaagtgtgagagctgcgtctataacatgatgggcaagcgcgagaaaaagctcggggagttcggccgcgccaagggctcccgggccatctggtacatgtggctgggcgcccgcttcctggagttcgaggcgctcggattcctgaacgaggaccactggtttggccgggagaacagctggtctggcgtcgagggggagggtctgcatcgcctcggatacatcttagaggagatagataagaaggacggagacttgatgtatgccgacgacacggccggctgggacacccggatcaccgaggacgatctccagaacgaggagctgataaccgagcagatggcaccccaccataagatcctggccaaagccatcttcaagctcacctaccagaacaaagttgtgaaagtgctgcgacccacgccgcgcggggccgttatggacatcatctcacggaaagaccagcggggttccggacaggtcggcacctacgggttaaatacgttcactaacatggaggttcagctcatccggcagatggaagccgagggcgtgatcacccaggatgacatgcagaaccccaaaggcctgaaggagcgggtcgagaagtggctccgggaatgcggggtagacaggctcaagcgcatggccatctctggcgacgactgcgtggtcaagccactggacgagcggttcggtacctctctactcttcttaaatgacatgggcaaggtgcgaaaagatataccccaatgggaaccatcgaagggctggaagaactggcaggaggtgcccttctgctcccaccacttccacaagattttcatgaaagacggccggagcttggtggtgccgtgcagaaaccaggacgagctcatcggccgggcgcgcatctcacagggcgccggctggtctctccgcgaaacagcctgtctggggaaggcctacgcccagatgtggtccctcatgtactttcaccggcgcgatctgcgtctggcgagcatggcaatctgcagcgccgttcccaccgagtggttcccgacgtccagaaccacttggagcatccatgcccaccaccagtggatgaccacagaggatatgctcaaagtttggaatcgggtctggattgaagacaacccaaacatgatagacaagacacccgtgcactcatgggaagacatcccgtacctggggaagcgtgaggacctctggtgtgggagcctcatcggcctgtcttctcgggccacgtgggccaaaaacatccacaccgccataacgcaggttcgcaatctgatcggcaaggaggagtacgtggactacatgcccgccatgaagcggtattcggcccctagcgagagtgagggggtgctctga

SEQ ID NO: 26263 - RNA, 9867 nt, synthetic construct
  misc_feature 1..9867: note = derived and/or modified CDS sequence (opt11) from DENV-4__FJ639736__SS-prME
  source 1..9867: mol_type = other RNA
agcactatgacccttctctgtctgatcccgacggcgatggcctttcacctatcgacccgcgatggcgagccgttaatgatcgtggcgaagcacgagcgggggcgccccctgctgttcaagactaccgagggcataaacaagtgcacattgatcgccatggatctcggcgagatgtgcgaggacactgtcacatacaagtgccccctacttgtgaacaccgagccagaggacatagactgttggtgtaacttgacaagcacgtgggtcatgtacggcacgtgcacgcagtccggggagcggcgccgggagaaacgttctgtcgcactgacaccgcactcgggcatgggcctcgagacccgggccgaaacttggatgagctccgagggggcctggaagcacgcgcagcgagtggaaagctggatcttacggaaccccggattcgccctcctcgcaggcttcatggcctacatgatcggccagaccgggatccagcgcacggtttttttcgtcctgatgatgctggtcgcgccctcctatgggatgcggtgcgtaggcgtaggcaatcgtgatttcgttgaaggggttagcgggggcgcgtgggttgacctcgtcctggagcacggcgggtgcgtgactaccatggctcagggcaaacccaccctggacttcgagctcacgaagaccaccgcaaaggaggtcgccctgctccggacctattgcatcgaggccctcatctctaacatcaccaccgcgacccgctgcccgacccagggggagccctacctgaaggaggagcaggaccagcagtacatctgccgccgcgacgtggttgaccggggctggggtaacggatgcggcctgttcgggaagggcggggtcgtgacgtgcgccaaatttagctgctccggtaagatcacggggaacctggtacaaatcgagaatctggagtacacagtcgtggtgactgtgcataacggcgacacgcacgccgttggcaacgacacaagcaaccacggcgtcacggccaccattacgccccgctcccccagcgtggaagtgaagctgccggactatggggaacttactctggactgcgagccccgttccgggatcgatttcaacgagatgatactgatgaagatgaagaagaaaacgtggttggttcacaaacagtggttcttagacctgccgctcccctggaccgcgggcgcagatacctcagaggtccactggaattacaaagagaggatggtaactttcaaggtaccgcacgccaagcggcaggacgtgaccgtactggggagccaggaaggcgccatgcactcagcacttgcgggagcgaccgaggttgacagcggggacggcaaccacatgttcgccgggcacctcaaatgcaaggtgcgcatggaaaaactgaggatcaagggcatgtcatataccatgtgcagcgggaaattttccatcgataaggagatggccgagacacagcacggtaccaccgtggtcaaggtgaagtatgagggcgccggtgcgccctgcaaggtgcccattgagatacgggacgtcaataaggagaaggttgtcggccgcgttatctcttctacacccttagccgagaacacgaactcggtaaccaacatcgagttggaaccgccctttggggactcctacatagtaatcggcgtagggaactcggcgctcaccctgcattggttccgtaaagggtcgagcatcggtaagatgttcgagtcaacctaccgtggggcgaagagaatggccatcttaggcgagactgcctgggacttcgggagcgttggcggcctgttcacctccctggggaaagcagtgcaccaggtcttcggctcggtgtataccactatgttcggtggcgtatcctggatgatccgcatattgattgggttcctggtcctgtggatagggacgaactctcgaaacacctctatggccatgacctgcatcgcggtgggagggatcacactgttcctcgggttcacggtacaggcggatatggggtgtgtcgtcagctggtccgggcgcgagctgaagtgcgggtcaggcatcttcgtggttgacaacgttcacacctggaccgagcaatataagttccagccagagagccccgcgcggctcgcctccgcgatcctgaacgcccacaaggatggcgtgtgcgggatccgcagcaccacgcgtctggagaatgtcatgtggaagcagatcacgaacgagctgaactatgttttatgggagggcgggcacgacttaacagtagtcgcgggtgatgtcaaaggagtactgacgaaggggaagcgcgccctcactccccctgtgtccgacctcaaatactcatggaaaacttggggaaaagcaaaaatcttcacccccgaggcacggaactcaaccttcctgatagacgggcccgacacgagcgagtgcccgaacgagagacgcgcttggaacagcctcgaagtagaggactatggatttgggatgttcactacgaacatctggatgaaatttcgtgagggctcgagtgaggtgtgcgatcaccggttaatgtcggcggccataaaggaccagaaggccgtgcacgcagatatgggctactggatcgagtcctcaaagaaccagacttggcaaatcgagcgcgcgtccctgatcgaggtgaagacgtgtctatggcccaaaacacacaccctatggagcaacggagtacttgagtcccagatgctcatccccaaaagttatgcgggcccgttcagccagcataactaccgccagggctacgcaacccagaccgtaggcccctggcacctggggaagctggagatcgacttcggagaatgccccggaaccaccgtgaccatacaggaggactgcgaccaccgtggtcccagtctccggacaacgactgcaagcggcaagctggtgacccagtggtgctgccggagctgcaccatgccacccctgagatttctcggggaagatggctgttggtatgggatggagattaggccgttgtctgaaaaggaggagaacatggtcaaatcccaggtgacggccggccagggcacaagcgagacattctccatggggctgctttgcctgacacttttcgtcgaggagtgcttacgccggagagtgacccggaaacacatgattctggcagtggtcatcaccctgtgcgccatcatcctcggagggctgacctggatggacctgcttagagcactaattatgctaggcgacaccatgagcggccggatcgggggccagacgcatctcgccatcatggctgtattcaagatgagtccagggtacgtgctgggcgtctttctacgcaagctcacttcgcgggagacagcgttaatggttatcgggatggccatgaccacgaccctgtccataccccatgacctcatggagctgatcgatggcatcagcctaggcttaatcctgttgaaaatcgttacccagttcgacaacacccaagtcggcactctcgctttatccttgaccttcatcaggagcaccatgagtctagtgatggcctggcggaccatcatggccgtcctgttcgtcgtgacgctgatccccctatgccgcacctcttgcttacagaagcagtcgcactgggtggagatcactgcgctaattctgggagcccaggcacttccggtatacctgatgactctcatgaagggggcctccaggcgctcctggcctctgaatgagggaataatggcggtagggcttgttagccttctgggctccgcgctgctcaagaacgatgtgcccttagccggtccaatggtggcagggggcctattactggccgcgtatgttatgagcgggtcgtccgcagacctgagtctggagaaggccgccaacgtccagtgggacgagatggccgacatcaccggctcaagtcccatcatcgaagtgaaacaggacgaggacgggtccttcagcatccgggacgtagaggagacaaatatgatcaccttgctggttaaactagcgctcatcaccgtcagcggcttataccccctagcgataccggtgacgatgaccctctggtacatgtggcaggtaaagacccagcgctctggtgccctgtgggacgtaccctcccctgccgccacgcagaaggcggccctcagtgaaggtgtgtaccgcatcatgcagagaggcttgttcgggaagacccaagtcggtgtgggaatacacatggaaggagtgttccacacgatgtggcacgtcacgcgcggctcagtgatatgtcacgagaccgggcggctagagccaagctgggctgacgtgaggaacgacatgatatcctacggaggtggctggcggctcggcgacaaatgggataaagaggaggacgtgcaggttctcgccatcgaaccggggaaaaaccccaagcacgtgcagaccaagccgggcctttttaagacactaaccggggagatcggcgccgtcacactggacttcaaacccgggaccagcggctcccccatcatcaaccgcaagggcaaggtgatcgggctgtacggcaacggggtggtcaccaagagtggtgattatgtttccgcgatcactcaagccgagcggatcggggaacctgactatgaagtagacgaggacattttccgcaagaagcggctaaccattatggacctccacccaggagcaggcaagaccaagcgcatcttaccgtctatagttcgggaggccctgaagcgccggctccgcaccctaatattagcgcccacccgggtggtggccgccgagatggaagaggccctccgtgggttaccgatccggtaccagacccccgccgtcaaatccgagcacaccggccgcgaaatagtggatctgatgtgccacgcgacgttcacaactcgtctcttaagcagcacacgggtgccgaactacaacctgatcgttatggacgaggcccatttcacggacccctcaagcgtagccgcacggggttacatcagtactcgtgttgagatgggcgaagccgcggccattttcatgactgctaccccccccggtgccacggacccattcccccagagcaatagtcccatcgaggatatcgagcgggaaatacccgagcggagctggaacacaggcttcgactggatcaccgactaccaaggcaagacagtctggttcgtaccatcgatcaaagccgggaacgacattgctaactgcttgcgcaagagcggcaagaaggtgatccagctatcgcggaaaacgtttgacacagagtatcccaagaccaaactgactgactgggattttgtggtcacgaccgacatctctgagatgggggcgaacttccgcgccggtcgcgtcatcgatccgcgcaggtgtctcaagcccgtgatcctaaccgacgggccggagcgcgtcatcctggccggcccgatccccgtcacacccgcaagtgccgcccagcggcgtggcagaatcgggcgcaaccccgcacaagaggacgatcagtacgtgttctcaggtgaccccttgaagaatgatgaggaccacgcccactggactgaagctaagatgctgcttgacaatatctacacccccgaggggatcattccaaccttgtttggcccggaacgtgagaagacccaggcaatcgacggtgagttcaggctaaggggagaacaacgcaagacgtttgttgaactaatgcgtcgtggggatttgcccgtctggctgagctacaaggtcgcctcagcagggatctcctacaaagaccgggagtggtgctttaccggtgaaagaaacaaccagatccttgaggaaaacatggaggttgagatttggacccgggagggggagaagaagaagctccgaccccggtggctggatgcccgcgtctacgcagaccccatggccctaaaggacttcaaggagttcgcttccggccgcaagtccatcaccctggatatcctgaccgagatcgcgagcttacctacctacctgtcaagccgggccaaattagcgctggacaacatcgttatgctccacactaccgaacgcggcggccgtgcctaccaacacgccttaaacgagctgcccgagagcctagagaccctgatgctggtggccctcctgggcgcgatgacggcagggattttcctgtttttcatgcagggcaaagggattgggaagctttcgatgggcctgatcaccattgcagtcgccagcgggttactctgggtcgccgagatccagccccaatggatagcagcaagtatcatcctggagttcttcctaatggtgctcttgatccccgagccagagaagcagagaacccctcaggacaatcagctgatttatgtcatcctgacgattctgacgatcattggtcttattgcagcaaacgaaatggggctcatcgagaagaccaagaccgactttggcttctaccaggtaaagacggagactaccatactggacgtggacctacgaccggcgagtgcatggaccctctatgcggtcgccaccacgatcctgacccctatgctgcgacacactatcgagaatacatccgcgaacctctcactggcagcgatcgccaatcaggccgcggttcttatgggcctcggcaaggggtggcccctgcacaggatggatctgggggtgcccttactggcaatgggctgctattcccaggtcaaccccacgacgttaacggcgagtctcgtgatgcttcttgtgcattacgccatcattgggccgggcttacaggcaaaggccacccgggaggcacagaagcggacggccgccgggatcatgaaaaaccccaccgtcgacggtatcaccgtaatagacttggagcccatttcctacgatcccaaattcgagaagcagctcgggcaggtgatgctcctggtcctctgcgccggacaactgctgctaatgcgtaccacatgggccttctgcgaagtgctgaccctagcgaccggcccgatccttaccctctgggaaggcaatcccggccggttctggaacacgaccattgcagtgagcaccgctaatatcttccgcggttcctatttggccggggccggcctggcgtttagccttatcaagaacgcccagaccccacgccgtgggacgggcaccacgggggagaccctgggcgagaaatggaagcgtcagctgaactcgttagatcgcaaagagttcgaggaatacaaacggagtggcatcctagaggtcgatcgcacggaggccaagtccgcactgaaggacgggtcaaagatcaagcacgccgtgtcccgaggaagttccaagattcgttggattgtcgagcgggggatggtcaagcctaagggcaaggtggtggatctcgggtgcggccggggcgggtggagctactatatggcgacattgaagaacgtgacggaggtgaagggctacaccaaggggggcccgggccatgaggagcccatccccatggccacctacggatggaatctagtgaaactccattctggcgttgacgttttctacaagcccaccgaacaggtggatacgctgctgtgtgacatcggcgaatcaagctccaacccgaccatagaggaaggccgcactctgcgggttctgaagatggtggaaccctggctgagctccaagcccgagttctgcattaaggttctgaatccctacatgccaacggtcatcgaggagctcgagaagttgcagcgtaagcacgggggcaacctggtacgctgccccctcagccgcaattccacccacgagatgtactgggtctcaggcgcctccgggaacatcgtgtccagtgtgaacacaaccagcaagatgctgcttaaccggttcaccaccagacacagaaaaccgacctacgagaaagacgtcgacctcggcgccggcactcggtccgtgtcaacggagaccgagaagcccgatatgacaatcatcggacggcgcttgcagcggctccaggaggagcacaaggaaacgtggcattacgatcaggagaacccgtatcgcacctgggcgtaccacggcagttatgaggcccccagcaccggctcggcaagctcaatggtaaacggagtggtgaagctcctgaccaagccctgggatgtgatcccgatggtcacccagctggccatgacagacaccacccccttcgggcagcagcgagtattcaaggaaaaggtggacactcgcacaccccagccaaagccgggcacccggatggtcatgacgaccacggccaactggctctgggcgcttctgggcaaaaagaagaaccccagactctgtacacgggaggagttcatcagcaaggtccgcagcaatgccgcgatcggtgccgtgtttcaagaggagcaagggtggacctccgcttccgaagcagtcaacgactcccggttttgggagctggtggacaaggagcgcgctctgcaccaggagggcaaatgcgagtcttgcgtttacaacatgatgggcaagagagagaagaagctaggggagttcggccgggccaaggggagtcgagccatctggtacatgtggctgggagcccggttcttagagttcgaggcactcggattcctgaacgaagaccactggtttggccgcgaaaactcatggtcgggcgtggagggggaggggttacatcggctcggatatatcctagaggagatagacaagaaagacggggacctgatgtatgccgacgacaccgccggttgggacacgcgcatcaccgaggatgacttacagaacgaagaactgatcaccgaacagatggcgccccatcacaagatcctggcaaaggccattttcaagctcacctaccaaaacaaagttgtgaaggttctgcggccaacaccgcgcggggccgtaatggacataatttctcgaaaggatcaacgcggctctggacaggtaggcacgtacgggctgaacaccttcaccaacatggaagtccagctcatccggcagatggaggctgagggcgttataacccaggacgacatgcagaacccgaagggcctgaaggagcgggtggaaaaatggctgcgggagtgcggggtcgaccgcctcaagcggatggccatcagtggcgacgattgcgtggttaagcccctggatgagcgttttgggacttccctgttgttcctaaacgacatgggtaaagtacggaaagacatcccacagtgggagccgagcaaggggtggaagaattggcaggaggttcctttctgttcccaccacttccacaagatatttatgaaggacggacgcagcctggtggtcccctgccggaatcaagacgagcttatcggccgagcgcgcatctcccagggggctggctggagcctgcgagaaactgcctgtctggggaaggcctacgcccagatgtggtccttaatgtactttcaccggcgggacttaaggctggcgagcatggccatttgctcggccgtgcccaccgaatggttcccgacaagcagaacgacctggagcatccacgcccaccaccagtggatgaccactgaagacatgctcaaggtgtggaacagagtctggattgaagacaatccaaatatgattgacaagacaccagtacactcttgggaggacattccctacttaggcaagcgggaagacctatggtgtggatcccttatcggcctgtccagccgagccacttgggctaaaaacatacacaccgctatcacccaagtgcggaatctgattggcaaggaggagtacgtcgattacatgccggtcatgaagaggtacagcgccccaagcgaatccgagggggtgctctga

SEQ ID NO: 26264 - RNA, 9867 nt, synthetic construct
  misc_feature 1..9867: note = derived and/or modified CDS sequence (opt11) from DENV-4__FJ639737__SS-prME
  source 1..9867: mol_type = other RNA
agcaccataaccctactctgcctgatccccacggtgatggccttccacttgtccacccgtgacggcgagccccttatgatcgttgccaagcatgagcgggggcgacccttattgttcaagacgacggaaggcatcaataagtgtacgctcatcgcgatggacctcggcgagatgtgcgaggacaccgtgacctacaaatgccccctgctcatcaacacggagccagaagatatcgactgctggtgcaacctgacgagcacctgggtgatgtacggcacctgcacacaatctggggaacggcgcagggagaagcgaagcgttgccctcacgccgcactccggcatgggcctcgagacccgggcagaaacctggatgtctagcgagggggcctggaagcacgcccaacgtgttgagagctggatcctgcggaaccccggctttgcgctgctcgccgggttcatggcttacatgatcggccaaaccgggatccagcgcaccgtgttcttcgtgctgatgatgctggtggctccctcctacggcatgagatgcgtgggcgtcgggaatagagacttcgtggagggcgttagcgggggcgcgtgggtagacctcgtgctggagcacggggggtgtgtgacaaccatggcacagggcaagcccacgctggatttcgaactcacaaagaccaccgccaaggaggtcgctctgctccggacctactgcatcgaagccctcatcagtaatataacgaccgcgacccgctgcccgactcagggggagccctacttaaaggaagagcaggaccagcagtacatctgccggagagacgtggtggaccggggctggggcaacggctgtggcttattcggcaagggcggggtggtcacgtgcgccaagttcagctgctccggtaagataaccggaaacctcgtgcagattgaaaacctcgaatacaccgtcgttgttaccgtccacaacggtgacacgcacgcggtgggcaacgacaccagcaaccacggggtaaccgctactatcacccccagatccccctcggtggaggtgaagctgccggactacggcgagctcaccctggattgtgaaccccggtccgggatcgacttcaacgagatgatcctgatgaagatgaagaaaaagacctggctcgtccacaaacagtggtttcttgacctgcccctcccctggaccgccggcgcggacacgagcgaggtccattggaactacaaggagaggatggttacgtttaaggtcccgcacgccaagcggcaggatgtcaccgtgctggggtcgcaggaaggtgccatgcacagcgccctggcgggcgcgactgaggtggactccggggacggcaatcacatgttcgccgggcacctcaagtgcaaggtgcgcatggagaagctgcgcatcaaagggatgtcgtataccatgtgcagcggtaagttttccatcgacaaggaaatggcggagacgcaacatggcaccaccgtggtcaaggtgaagtacgagggcgccggggccccatgtaaagtgcctatcgagatacgtgacgttaacaaggagaaagtggtgggccgcgtaatcagctctaccccactggcggagaatacgaacagcgtgaccaacatcgagcttgaaccgcccttcggggactcgtatatcgtaatcggcgtcggcaacagcgcactcaccctgcattggttccggaaagggtccagcatcggcaagatgttcgagtcgacctaccgcggggcaaagcggatggcgatccttggagagacggcgtgggacttcggatctgtgggaggcttattcacatccctggggaaggcagtacaccaggtattcggcagcgtgtacaccacgatgttcgggggagtgtcatggatgatccgcatcctgatcgggttccttgtgctgtggatcggaacgaactctaggaacacgtccatggccatgacctgcatcgccgtaggcggtatcaccttattccttggctttacggtccaggctgacatggggtgcgtcgtgagttggtccggtcgcgagctgaaatgcgggagcggaatctttgtggtcgacaacgtgcacacctggaccgagcagtacaagtttcaaccagagagccccgcccgattggcgtctgcaatactcaacgcgcataaggacggtgtgtgcgggatccgcagcaccacgcgcctggagaacgtcatgtggaagcagataaccaacgagctgaactacgtgctctgggagggcgggcacgacctgaccgtggtcgccggcgacgtaaagggcgtgctgaccaaagggaagcgggcgttaacaccgcccgtctccgacctgaagtacagctggaagacttggggcaaggccaagatattcacccccgaagcccggaactccaccttcctgatcgacggtcccgacacgagcgagtgccctaacgaaaggcgggcttggaactcccttgaggtcgaggactacggcttcgggatgtttaccaccaatatttggatgaaattcagagagggcagctccgaggtgtgcgaccatcgcctgatgagtgcggcgatcaaggaccagaaggcagtacacgcagacatgggatactggatcgagtccagcaaaaaccagacttggcagattgagcgcgcatccctgattgaggtgaagacatgtctctggcccaagacccacactctgtggagcaatggggtgctggagtcccagatgttgatccccaaaagctacgcgggaccgttctcccagcacaattaccggcagggctacgccacccagaccgtcgggccctggcaccttgggaagctggagatcgactttggtgagtgccccggcacgaccgtgaccatccaggaggactgcgatcaccgcgggccatctctccgcaccacgactgccagcggcaagcttgttacgcaatggtgctgccggtcgtgcaccatgccgcccctgcgcttcctcggggaggacggctgttggtacgggatggagatcagacccctgagcgagaaagaggaaaacatggttaagagtcaggtgactgctggccagggcacctctgagaccttttccatggggctgctctgcctaaccctgttcgttgaggagtgcttacgccgtcgcgtcactcggaagcacatgatcctagctgtggtcatcaccctgtgcgcgatcattctcggcgggctgacctggatggacctgctccgcgccttaataatgcttggcgacaccatgagcggacgaattgggggccagacgcacctcgccatcatggccgtattcaagatgtcccccgggtacgtgctgggcgtattcctgcgcaagttaaccagccgggagacagccctgatggtgatcgggatggcgatgaccacgaccctgagtatcccccatgatctcatggagcttattgacggcatcagcctagggttgatcctcctaaagatcgttactcaatttgatgacacccaggtcgggacgctcgcactgtcccttacattcatacgttctaccatgagtctagtgatggcgtggcggacgatcatggccgtgttgttcgtggtgacgctgatccccctctgccgcaccagctgcctgcagaagcagtcccactgggtggagatcacagcattaatactcggcgcgcaagccctgcccgtgtacttaatgacccttatgaagggggccagccgccgctcttggcccctgaacgagggcatcatggccgtggggctggtgagcctcctggggtccgctctgctcaaaaacgatgtccccctggcagggcccatggtggccggaggcttactactggccgcttacgtgatgtcgggatcatccgccgacctgagcctcgagaaagccgcgagcgtccagtgggacgaaatggccgacatcacggggtcgtcccccatcatcgaggtgaagcaggacgaggacgggtcattctccatccgggatgtggaggaaaccaatatgatcaccctgctggtcaagctcgccctgatcaccgttagcggcctttaccccctcgcgattccggtgacgatgaccctctggtacatgtggcaggtcaagacccagaggagtggcgccctgtgggacgtgcccagccccgccgcaacccagaaggccgccctgtccgagggggtatatcgcatcatgcagcgcggcctgttcgggaagacccaggtaggcgtgggcattcacatcgagggagtattccacacgatgtggcacgttacccggggaagtgtgatatgccacgagactgggcgcctggagccaagttgggcagacgtgcgcaatgatatgatatcgtacggcgggggttggcggctcggcgataagtgggacaaggaggaggacgttcaggtcctggcaattgagccagggaagaaccccaaacacgtgcagacgaagcccggcctgttcaagacgctcaccggggagatcggcgccgtcaccctggacttcaagcccggtacctccggctccccgatcatcaacagaaagggcaaggttatagggctgtacggcaatggggtggtcacgaaatcgggcgactacgtaagcgccatcacccaggccgagcgaattggggagcccgactacgaggtggacgaggacatcttccgtaagaagcggttaaccatcatggacctgcaccccggcgccggcaaaacgaagcgcattctgccgtccatagtccgggaggccctgaagcgccggctccggacgcttatcctcgcccccacccgggtagttgccgccgagatggaggaggccttacgtggtctccccatcaggtaccagacacccgctgtgaagagcgagcacaccggccgcgagatcgtggatctcatgtgccacgccacgttcaccaccagactcttatcgtccacgcgcgtacccaactacaacttaatcgttatggacgaggcgcacttcacggatcccagctccgttgccgcccggggatacatcagcacccgggtcgagatgggtgaggcagccgcgatattcatgaccgcaaccccccccggggcaacggacccattcccccaatccaacagccctatcgaagacatcgagcgtgagatccccgaacgctcctggaacacaggattcgactggatcaccgactaccagggaaaaaccgtgtggttcgtgcctagcataaaagccgggaacgatatcgccaactgtttgcgcaagagcggcaagaaggtcatccagctgagccggaagacattcgacaccgagtaccccaagaccaagctgaccgactgggacttcgttgtgaccaccgacatcagcgagatgggggcgaacttccgtgcgggccgcgtcatcgacccccgccggtgcctaaagcccgttatcctgaccgacggaccggagcgagtgatcttagccggtcccataccggtcacccccgccagcgcggcgcagcgtcgaggcagaatcggccgcaacccggcccaagaggacgaccagtacgtcttctccggcgacccgctcaaaaacgatgaggaccacgcccactggacggaggccaagatgcttctggacaacatttatacccccgaggggataatccccaccctcttcggccccgagcgggaaaagacccaagcgatcgacggtgagttccgcctgagaggcgagcagcgcaagacgttcgtggagctgatgcgacgcggagacctccccgtttggctgagctataaagtggcctccgccgggatttcttacaaggaccgggagtggtgcttcaccggcgagaggaacaaccagatcctggaggagaacatggaggtggagatctggaccagggagggagagaaaaagaagctccgcccccggtggctagacgccagagtctacgccgacccaatggcgctgaaggactttaaggagttcgcctcgggccgcaagtcaatcaccttggacatattaacggagatcgcctccctgcccacgtacctctctagccgggccaagctggccctggacaacatcgtgatgttacacaccaccgagcgcggcgggcgggcgtaccagcatgccctgaacgagctgcccgagtccctcgagaccctgatgctagtggcactcctgggagccatgacggcggggatcttcctgttcttcatgcagggcaagggcatcggcaaactgtctatgggcctgatcacaatcgccgtcgcctctggtcttctctgggtagccgagatacagccccaatggatcgccgcctctatcatcctggagttcttcctgatggtgctccttatcccggagcccgaaaagcagcgcaccccccaggacaaccagctgatttacgtgatcctgaccatcctgacaattatcggcctgatcgccgcaaacgagatggggctaatcgagaaaaccaagaccgatttcggcttttaccaggtgaaaaccgaaacgaccatcctggacgtggacctaaggcctgcgtctgcttggaccctctacgctgtcgcaaccacgatcctgaccccgatgctgcgccatacgatcgagaacactagcgccaacttgtccctggcggccatcgcgaatcaggccgccgtgcttatggggctcggaaagggctggccactgcaccgtatggacttaggggtgcccctcctcgccatgggctgctacagccaggtaaaccccactaccctgaccgcctccctcgtgatgctgctggtccactacgcaatcatcggaccgggcctccaagcgaaggccaccagagaagcccaaaagcggacggcggccggcatcatgaagaatcccaccgtcgacgggataaccgtgatcgacctggagcccatctcctatgacccaaaattcgagaagcagcttggccaggtcatgctcctggtgctgtgcgccgggcagctccttctaatgcgcacgacctgggccttctgcgaggtgctcaccctggctacaggcccgatcttaaccctttgggaggggaaccccggacggttctggaacacgacaatcgcggtgtccaccgccaacattttccgcggcagctacctggccggggccggtcttgctttttccctaatcaagaatgcgcagaccccccggcgcgggacgggcaccaccggggagacccttggtgagaaatggaagaggcagctgaacagcctcgaccgcaaagagttcgaggagtacaagcgctccggcatcttggaggtcgaccgaactgaggccaagtccgccctgaaggacgggtccaagatcaagcacgccgttagccggggctcctcaaagatacgctggatcgtggagcgcgggatggtgaaacccaagggcaaggtggtggacttagggtgcggccgcggcggctggagctactacatggcgacgcttaagaacgtaaccgaagtgaagggatacactaagggggggccggggcatgaggagcccatccccatggcgacctatggttggaacctggtgaagcttcattccggagtggacgtattctacaagcccatagagcaggtcgacactctactgtgtgacataggtgagagttccagcaaccccaccatcgaagaaggccgcaccctacgggtcctgaagatggtcgagccatggctgtccagcaagcccgagttctgtattaaagtgctgaatccctacatgccgaccgttatcgaggagctagaaaagctgcagcgcaagcacggcggcaacctcgtgcggtgtcccctctcccgcaacagcacgcacgagatgtactgggtctccggcgccagcgggaacatcgtgagcagcgtcaacactacctccaagatgctgctgaaccggttcaccacgcgccaccggaagcccacctatgagaaagacgttgaccttggcgctggcacgcgcagcgtctccacggagacggagaagcccgacatgacgattatcggcagacgcctgcaaagactgcaggaggagcacaaggaaacctggcactacgaccaggagaacccgtaccgcacctgggcctatcacgggagctatgaggcgccatctacgggtagcgcctccagcatggtgaacggtgtcgtgaaactcctgaccaagccctgggacgtaatcccgatggtcacccagctggctatgaccgatacgacccccttcgggcagcagcgcgtgtttaaggaaaaggtggacacacgcaccccccagcccaaaccgggcacccggatggtcatgaccaccaccgcaaactggctttgggccctgctggggaagaagaaaaacccacgcctttgcacgcgggaggagttcataagcaaggtgagatccaacgccgccatcggcgctgtgtttcaggaggagcagggatggaccagcgcgtccgaggcagtcaacgatagccgtttctgggagttagtggacaaggaacgcgcgctgcaccaggagggcaaatgtgaatcctgcgtgtacaacatgatgggcaagcgcgagaagaagctcggtgagttcggacgggccaaagggagccgtgccatctggtacatgtggctgggcgcccgcttcttggagttcgaggcactcggtttcctgaacgaggaccactggttcggccgcgagaactcctggagcggcgtcgagggagaaggactacatagactcggttatatcctggaagagatcgacaagaaggatggcgacctgatgtacgcggacgacacagccggctgggacacccgtatcacggaggacgacctgcagaacgaggagctgattaccgagcagatggccccgcaccacaaaattctggccaaagcgatcttcaaactcacctaccagaacaaggtggtgaaggtcctgcggccgaccccgcgcggggccgtgatggacatcatttcccgtaaggaccagcgcggaagcggtcaggtcggcacctacgggttgaacacattcaccaacatggaggtccaactcatccggcagatggaggccgagggcgtgatcacccaagacgacatgcagaaccctaaaggcctcaaggagcgcgtggaaaagtggctgcgggaatgcggggtcgatcgcttgaagaggatggccatcagcggagacgactgcgtagtgaagcccttagacgaacgcttcgggacctcactgctattcctgaacgacatgggcaaggtaaggaaggacataccacagtgggaaccgagtaaggggtggaagaactggcaggaggtgccattctgctcacatcacttccacaagattttcatgaaggacggccgctccctggtggtcccgtgccggaatcaggacgagctcatcggccgcgcccgcatcagccagggggcaggttggtcgctcagggagacggcctgtctcgggaaggcatacgcccagatgtggtccctgatgtattttcaccgccgggaccttcgcttggcgtcgatggcgatctgctctgccgtgcccactgagtggttccctaccagccggaccacgtggtccatacacgcccaccaccagtggatgaccaccgaagacatgctcaaggtgtggaatcgcgtctggatagaggataaccccaacatgatagacaagactcccgtccactcctgggaggacatcccctatctcggtaagcgggaggacctgtggtgcggttccctcatcggtctgagctccagagccacgtgggcaaagaacatacacacagcaatcactcaggtgcggaacctgatcggcaaggaggagtacgttgattatatgccggtgatgaagcgctactctgcgccctccgagagcgagggtgtgctctga

SEQ ID NO: 26265 - RNA, 9867 nt, synthetic construct
  misc_feature 1..9867: note = derived and/or modified CDS sequence (opt11) from DENV-4__FJ639738__SS-prME
  source 1..9867: mol_type = other RNA
tcgacgatcaccctgctctgcctgatccccaccgtgatggcctttcacctgtcaacgcgcgacggggagcccctcatgatcgtcgccaagcacgagcgggggcgccccctgctttttaagacaaccgagggcatcaataagtgcacgttaattgccatggacctgggggagatgtgcgaggacactgttacctacaagtgtcccctgctcgttaacactgagcctgaggacatcgactgttggtgtaacctgacgtcgacctgggtcatgtacgggacctgtactcagtccggggagaggcgccgggagaagagaagcgtagccctgacgccgcactccggcatgggcctcgagacccgagccgagacctggatgagctctgagggggcctggaagcacgcccagcgcgtcgagtcctggatcctgcggaatcccggctttgcgctccttgccggttttatggcatatatgataggccagacaggcatccagcgcacggtgttcttcgtgctgatgatgctggtggccccttcctacggcatgcgctgcgtcggcgtgggcaaccgcgacttcgtggagggcgtcagcggaggggcttgggtggatcttgtactggagcacggagggtgcgtcaccaccatggcccagggaaagcccactctggacttcgaactcactaagactaccgccaaagaagtggctctgctgcgtacgtattgcatcgaagcgctcatctccaacatcacgaccgcgactcgctgtccgacccagggagaaccttacctgaaggaggaacaagaccagcaatatatctgccggcgcgacgtggtcgaccggggctgggggaacggttgcggcctctttgggaaaggcggggtggtgacctgcgcgaagttcagctgctcgggcaagatcactgggaacctcgtccaaatcgagaatctagaatataccgtggtggtcacagtgcacaacggcgatacgcatgcggtcggcaacgacaccagcaaccacggcgtgaccgcgacgattacgccccgctccccaagcgtggaggtaaaactgccggactacggcgaactcaccctggactgcgagcctcggtccgggatagacttcaacgagatgattctgatgaaaatgaagaagaagacctggctcgtacataagcagtggtttcttgacctaccgttgccctggaccgcaggcgcagacaccagcgaggtgcattggaactataaggaacgcatggtaacgttcaaggttccgcacgctaagcggcaagacgtgaccgtcctgggatcccaggagggcgccatgcactcagccctggccggcgcgaccgaggtggacagcggggacggcaaccatatgttcgcgggacacctcaagtgcaaggtccgcatggaaaagctgagaataaagggtatgtcctacactatgtgcagcggcaagttctccatcgacaaggagatggctgagacgcagcacgggaccaccgtggtgaaggtgaagtacgagggcgcaggcgcaccttgcaaggtccccatcgagatccgggacgtgaacaaggagaaggtggttgggcgcgtgatcagctccacccctctggcggagaatacaaactcggtgaccaacatcgagctcgagccgcctttcggcgactcctacattgtcatcggggtgggcaattcggccctcactctgcattggttccggaaaggtagcagcatcggcaaaatgtttgaaagcacgtaccgcggagccaagaggatggcgattttaggggagacggcctgggacttcggatctgtgggaggcctgttcacatcgctggggaaggccgtccaccaagttttcggctctgtttataccacaatgttcgggggcgtctcatggatgatccgcattctaattgggttcctggtgctgtggatcgggaccaacagccgtaacacctccatggccatgacgtgtatcgcggttggcgggatcaccctgttcttaggattcacggttcaggccgatatggggtgtgtggtgagttggtccggccgcgagctgaaatgcgggtcgggcatctttgtcgtggacaacgtgcatacgtggactgaacaatacaaattccagcccgagtcacccgccaggctggcctcagccatactcaacgcccacaaggatggcgtatgcgggatccgtagcaccacgcggctggagaacgtcatgtggaagcaaataactaacgaactgaactacgtgctctgggagggcgggcatgacttaaccgtggtggccggcgacgttaagggcgtcctcaccaaggggaaaagggcgctcaccccgcccgtgagtgacctgaagtactcttggaagacctgggggaaggccaaaatttttactcctgaagcccggaactcaacgttcctgatcgatgggccggacacgagcgagtgcccgaacgaacggcgggcctggaactcattagaggtcgaggattacggcttcgggatgttcaccacaaacatctggatgaaatttcgcgaggggtcgtccgaagtctgcgaccaccggctaatgagcgccgccatcaaggaccagaaagcggtgcacgccgacatgggatactggattgagtcctccaaaaatcagacctggcagatagaacgcgcctctctgattgaggttaagacgtgcctctggcccaagacccacacgctgtggagcaacggggtcctggagagtcagatgctcatccccaagagttacgcggggccgttctcccagcacaactaccggcaagggtacgccacccaaactgtgggcccctggcacctggggaagttggaaatcgactttggagagtgtcctggcacgaccgtgacgatccaagaggactgcgaccatcgcggccccagcctccgcaccaccaccgcgagcggcaagctggtcacccaatggtgctgccggtcctgcaccatgccacccctgaggttcctcggggaggatggctgctggtatggaatggaaattcgtcccctgagcgagaaggaggaaaacatggtgaaatcgcaggtaacggcaggccagggcaccagcgaaacattttccatggggctgctctgtctgacactgttcgttgaggagtgcctgcgacgtcgggtgacgcggaagcacatgatactggcggtcgtaataaccctttgtgcgatcatcttaggagggctgacttggatggacctgttacgcgcgctgatcatgctgggtgacacgatgagcggccggatcggaggccaaacgcatctcgcaatcatggccgtgtttaagatgtcccccgggtacgtcttaggggtgttcctacgccggttgacgagccgcgagacagccttaatggttattggaatggcgatgaccaccaccctgagtatccctcatgacttaatggagctgatcgatggcatatcgctgggcctcatcctgctcaagatagttacccagtttgacaacacccaggtggggacgctcgccttatccctgactttcatccggtccaccatgagcctagtgatggcctggcgtaccataatggccgtcttgttcgtggtgacgctgatacccctctgccggacctcatgcctgcagaagcagagccattgggtcgagataaccgccctaatactcggcgcacaggccctgccagtttacctgatgaccctcatgaagggggctagccgacgatcgtggcccctgaacgagggcatcatggccgtggggctggtcagtctgctgggctccgcgcttctcaaaaacgacgttccgctggccggacctatggtggccgggggccttttactggccgcttacgtcatgagcgggtccagcgcagacctgagcctcgagaaggccgccaacgtgcagtgggacgagatggccgacatcacgggctcctctcccatcatagaggtcaaacaggacgaggacggctccttcagcatccgcgacgtcgaagaaaccaacatgatcacgctgctcgtaaagctcgccctgataaccgtgtccggcctatacccccttgctatcccggtcacgatgacgctgtggtatatgtggcaagtgaaaacccaacgctctggcgccctgtgggacgttccatcccccgccgcgactcagaaggccgcgctttcggagggggtctaccgaatcatgcagcgtggtctgttcgggaagactcaggtgggcgtcgggatacatatggaaggcgtgttccacacgatgtggcacgtcacgcgcggcagtgttatctgccacgagaccgggcgcctggagcccagctgggccgacgtccggaatgacatgatatcctacggagggggctggcgcctcggtgacaagtgggacaaagaagaggacgtgcaggtacttgccgttgaaccgggtaagaaccctaaacacgtgcagaccaagcccggtctgtttaagacgatcaccggtgagatcggggccgtgaccttggattttaagcccggcacaagcggctccccgattatcaaccggaagggcaaggtcatcgggctgtacggcaacggcgtggtaacgaagagtggcgactacgtatctgccatcacccaggcggagcgcatcggggagcccgactacgaagtggacgaggacattttccggaagaaacgcctcaccattatggacctccaccccggggccggcaagaccaagcggatattaccgtctatcgttcgcgaggcccttaagcggcgcctgcggacgctcatccttgccccaacgcgcgtcgtggcggccgaaatggaggaggccctgcgagggctccccatccgctaccagacccccgcagttaagtccgagcacaccggccgggagatcgtcgacctaatgtgccacgccacgttcaccacccgcctgctttctagcacacgggtcccgaattataacctaatagtcatggacgaggcgcacttcacggacccctccagcgtggccgcccgcgggtatatatccacccgggtggaaatgggagaagccgctgcgattttcatgacagctacaccacccggggccaccgatcctttcccgcaatccaactcccccatcgaagacatcgagcgagaaatccccgagaggagttggaacaccggcttcgactggataaccgactaccagggcaaaacggtatggttcgtcccgtccataaaggctgggaacgacatcgctaactgcctgcgaaaaagcggcaaaaaggtaatccagctctccaggaagacgtttgacaccgagtacccgaagacgaaacttacggactgggacttcgtggtcacgaccgacatttctgagatgggggcgaacttccgggccggccgcgtgatagacccccgtaggtgccttaagcccgtgatcctcacagacgggccggaacgggtgatcctggctggaccaattcccgtgaccccagcctccgcggcccagcgccggggcaggataggacggaaccccgcacaagaggatgatcagtatgtcttctctggcgaccccctgaagaatgacgaagaccacgcgcactggacggaggccaagatgttattggacaacatatacacccccgagggaatcatccccaccttattcggcccagagcgagaaaagacacaggcgatcgacggcgagttccggctccgcggggagcagcggaagacgttcgtagagttaatgcgtcggggcgacctgcccgtgtggctctcctacaaggtcgcgagcgccgggatttcctacaaggacagagaatggtgttttacaggggagcggaacaaccagatcctagaggaaaacatggaggtggagatctggacccgggaaggtgagaagaagaagctgcgtcccagatggctcgatgcccgcgtgtacgccgatcccatggcacttaaggactttaaggagttcgccagcggtcggaagtccatcacactcgacatcctcaccgagatcgccagcctgccgacatacttgagctcacgcgccaaactcgccctggacaacatcgtcatgctgcatactactgagcgaggcggacgcgcttaccagcacgcgctcaacgagctgccagagtcacttgagacgttgatgctagtggccctgttgggcgccatgacggcggggattttcctgttctttatgcagggcaagggcatcggcaaactttcgatgggcctcatcaccatcgccgtcgccagcggactgctgtgggtcgccgaaattcagccacagtggatcgcggcctcgatcatcctagagtttttcctaatggtgttgctcatcccggaacccgagaagcaacggacaccccaggacaaccagcttatctacgtaatcctgacgatcctcaccatcatcggtctgatcgccgctaacgagatgggactaatcgagaagaccaagaccgacttcggcttctatcaggtcaagaccgagacgactattctggacgtggatctgagacccgcgagcgcctggaccctgtacgcggtggcaaccacgatattgaccccaatgctgcggcatacgatcgagaacacctccgccaacctgagccttgctgccatcgccaaccaagctgcggtcctgatgggactgggtaagggctggcccctccaccgcatggacttgggcgtaccgctgctcgccatgggttgctactcccaagtgaatcccacgaccctgaccgcttctctcgtcatgctcctggtccactacgcgataatcggtccgggcctccaggctaaggccacccgggaggcccaaaaacggacggcagccggcatcatgaagaatcccaccgtggatgggatcactgtcatcgacctcgagcccatctcatacgatccgaaattcgaaaagcagctgggccaagtgatgctgctcgtgttgtgtgcagggcagctcttattaatgcggacgacttgggccttctgcgaggtcctgaccctcgcaactggcccgatcctgaccctgtgggagggaaacccaggacgcttctggaacacgaccatagcggtgagcaccgcgaacatattccggggctcctacctcgctggggccggcctcgccttctccctgatcaaaaacgcacaaaccccacgacgaggtacgggaaccacgggggaaaccctaggcgagaagtggaagcgccagctgaactccctggataggaaggagttcgaagagtacaagcgcagcggcatcctcgaggtggaccgtaccgaggcaaaatcagcgctgaaggatgggagtaagatcaagcacgccgtatcacgcggctcctccaagattcgctggatcgttgaacggggcatggttaagcccaaaggcaaggttgtggacctgggttgcggtcgtggcgggtggtcctattacatggctacgctgaagaacgtgactgaggtcaagggctacaccaaagggggccctgggcacgaggagccaatccctatggcgacatacgggtggaatcttgtcaagctgcatagcggcgttgacgtcttctacaagcccacggaacaggtggacacgctcctgtgcgacatcggggagagctcgagcaatcctactatcgaagaaggccggacgctacgcgtgctaaagatggtcgagccgtggctttcaagcaagcccgagttttgcataaaggttctgaacccctatatgccgactgtcatcgaggagctggagaagctccagcggaagcatggtggcaatctggtacgctgccccctgagtagaaattcgacgcacgaaatgtactgggtctctggggcctcggggaacatcgttagctccgtgaacaccactagcaagatgctcttaaaccgctttacaacccgtcatcgcaaacccacctacgagaaggacgtggacctgggtgccggcacacggtcagtaagcacggaaacagagaaacctgacatgacaatcattggccgccggctgcagcgccttcaggaggagcataaggaaacgtggcactacgaccaagagaacccgtacaggacgtgggcttaccatggatcctacgaagcgccctccaccggctcggccagctccatggtgaacggcgtggttaagctgctcaccaaaccctgggacgtgatacctatggtgacccagctggcgatgacggacaccaccccctttggacagcagcgcgtttttaaggaaaaggttgacacccgaacgccccaaccaaaaccaggaacccgcatggtgatgacgaccacggcaaactggctgtgggcactgctggggaagaagaagaatccccggttatgcacaagagaggagttcatctcaaaggtccggagtaatgcggctatcggagccgtcttccaggaggaacaggggtggacgtccgccagcgaggccgtgaacgattcccgcttttgggagctagtcgacaaggagcgggcgcttcaccaggagggcaaatgtgagagctgcgtgtacaacatgatgggcaagcgggaaaagaaactaggggagttcggacgcgccaaggggtcccgggccatctggtacatgtggctcggggccaggttcctggagttcgaggccctgggcttcctcaacgaagaccactggtttggcagggagaatagctggagtggcgtagagggggagggcctgcaccgcctggggtacatccttgaggagatcgacaagaaagacggtgatctgatgtatgcagatgacaccgccggctgggatacgcgtatcaccgaggacgacctgcaaaacgaggagctcatcactgagcaaatggccccgcaccacaaaatcctggcaaaggcgattttcaagctgacctatcagaataaggtagtcaaggtactcaggcccacccccagaggggccgtcatggacatcataagcaggaaggatcagcggggctccggacaggtgggcacatacgggctgaacaccttcaccaacatggaagtacagcttatccgccagatggaagccgagggggtgatcacacaggatgacatgcagaaccccaaaggtctcaaggagcgtgtggagaagtggcttcgcgagtgcggagtggaccgtttgaagcgcatggccatctctggcgacgactgcgtcgtgaagcctctcgacgaacggtttggaacgtccctgcttttcttgaacgatatgggtaaggtgcgtaaggatataccacagtgggagccatcgaaggggtggaaaaactggcaggaggtcccattttgttcccaccacttccacaagatttttatgaaggacggacggagcctggtagtgccttgccgtaaccaagacgagctgattggaagggcccggatttcccagggggcgggctggagcttacgcgagacagcatgtctgggtaaggcatatgcgcagatgtggtccctcatgtacttccaccggcgcgaccttcggctggcgagcatggcgatctgcagcgccgtccccactgagtggttccctacctcccgtacgacctggagcatacacgcacaccaccagtggatgacgactgaggacatgcttaaggtgtggaaccgcgtatggatcgaagacaaccccaacatgatcgacaagactcccgttcattcctgggaggacatcccttacttgggtaagcgcgaggacctgtggtgcgggagcctgatcggcctctccagcagagccacctgggctaagaatatacataccgcgattacacaggtgcgcaacctgatcggtaaggaggagtatgtagactatatgccggttatgaaaagatactccgccccctcggagtccgagggggtgctgtaa

SEQ ID NO: 26266 - RNA, 9867 nt, synthetic construct
  misc_feature 1..9867: note = derived and/or modified CDS sequence (opt11) from DENV-4__FJ639739__SS-prME
  source 1..9867: mol_type = other RNA
agcaccatgaccctgctctgcctgattcccactgctatggccttccacctttccacgcgagatggcgagccgctcatgatcgtcgcgaagcacgagcgggggcgtcccctgctgttcaagaccaccgagggcatcaataagtgcacgctgatcgccatggatttaggggaaatgtgcgaggacaccgtcacctacaagtgcccactcctagttaacactgagcccgaggacattgattgttggtgcaaccttacgtctacctgggtgatgtacggtacctgcacccagtccggggagcgaagacgcgagaagcgaagcgtggcattaacgccgcactccggcatgggcctagagacccgggcagaaacctggatgagctcagaaggggcttggaaacatgcgcaacgcgttgagtcatggatcctgaggaaccccgggttcgccttgctcgccggttttatggcctacatgatcggtcaaactgggatccaacgcacagtgttctttgtcctgatgatgctcgtggctccttcctacggcatgcggtgcgtcggcgtcgggaaccgcgatttcgtggagggcgtgagcgggggcgcctgggtcgacctcgtgctggagcacggcggttgtgttacgaccatggcccagggcaagccgaccctggactttgagctcaccaaaaccacggcaaaggaggtcgccctgctgcggacttactgtatagaggcgctcatctccaatatcacgaccgcaaccagatgtcccacccagggtgagccctatctgaaggaggagcaggaccagcagtacatctgtcggcgcgatgtggtagaccgtggctgggggaatggctgcgggctgttcggcaaaggtggcgtggttacatgcgccaaattcagctgctccggcaagataacagggaacctcgtacagatcgagaacctggaatacaccgttgtggtcaccgtgcacaacggcgacacgcacgcggtgggcaacgacactagcaaccacggggtgacggccactatcacgccccgctcgcccagcgtggaggtaaaactgccggactatggtgagctcaccttagactgcgagccccggtctggtatcgacttcaacgagatgatcttgatgaaaatgaagaagaaaacctggttggtccacaagcaatggtttctggatctccctctcccctggactgcgggcgccgatacgtccgaggttcactggaactacaaggaacgcatggtcacattcaaggtccctcatgccaagagacaggacgttaccgtactgggatcccaggaaggcgcgatgcacagcgccttggcaggcgccaccgaggttgacagcggagacggcaaccacatgttcgctggacacctcaagtgtaaggtccgaatggaaaagctgaggattaagggcatgagttacaccatgtgctccggcaagttcagcattgacaaggagatggccgagacgcagcacggcaccaccgtggtaaaggtgaagtacgagggagccggggcgccctgcaaagtccccatagagattcgggacgtaaataaagagaaggtggtaggccgggtcattagctcaactcccctggctgagaatacgaatagcgtgaccaacatagagctcgagccgcccttcggggacagttacattgtaatcggcgtcggcaatagtgctctgacgctgcactggttccggaaagggtcctccatcggcaagatgttcgagtccacataccgcggcgccaagagaatggcgatcctcggcgagacagcgtgggacttcgggagtgtgggcggcctattcacaagtctaggaaaggccgttcaccaggtcttcgggagcgtatacacgacaatgttcgggggcgtgtcttggatgatccgcatcctcattgggttcttagtcctgtggatcggcactaacagccggaacacttcaatggcaatgacatgcattgccgtgggcgggatcaccctgttcttgggcttcactgtgcaggcggacatggggtgcgttgtgagctggagcggtagggaattaaagtgtggtagcggaatttttgtggtcgataacgttcacacctggacggaacagtacaagttccaacccgagagccccgcacgtctggcctccgccattctcaacgcccacaaggacggcgtatgcggcatcagaagtaccacccggttggagaacgtaatgtggaagcaaataacgaacgagctcaactacgtgctatgggaaggaggacacgacttaactgtagttgcgggcgacgtgaagggcgtgctgactaaggggaagcgcgccctcacgccgcccgtatccgacttaaaatacagctggaaaacctggggcaaggccaaaatcttcactccggaggcccgcaactcaacgttcttgatagacgggcccgacactagcgagtgcccaaacgagcgccgggcatggaactccttagaagttgaagattacggcttcgggatgttcacaaccaatatctggatgaagttccgcgaggggagctccgaggtgtgcgatcaccggctcatgagcgccgccatcaaagaccaaaaggcagtacatgccgacatgggctattggatcgagtcaagcaagaaccagacctggcaaatagagagagcgtccctgatagaggtgaagacttgcctctggcctaagacccacactctgtggagtaacggggttctggaatcacaaatgcttatccccaagtcgtacgccggcccgttttcccaacacaattaccggcaagggtacgcaacccagacggtcggcccctggcacctagggaaactggagattgactttggcgagtgtcccggaaccaccgtcaccatccaggaggactgcgaccacagaggtccctcactccgtaccacaacagccagcggtaagctggtgacccagtggtgttgcaggtcatgcacgatgccgccactgcgctttttaggggaagatgggtgctggtacgggatggagatccggcctctgtctgagaaagaggagaacatggtcaaatcccaggtgacggccggacaggggaccagtgagacgttctccatggggctgttgtgcctgaccctgttcgtcgaggagtgcctccgtcggcgcgttacgcggaagcacatgattctggcggtcgtaatcaccctgtgtgcaatcatactcggcgggctgacctggatggacctgcttcgtgccctgataatgctgggcgacaccatgagtggcagaatcggaggccagacgcatctcgccataatggccgtattcaagatgagtccgggctacgtgttaggcgtcttcttacgcaagctcacaagccgggagaccgcactcatggtgatagggatggccatgacaaccaccctgagtataccgcatgatctcatggagctaatcgacggcatcagcctgggccttattctactcaagatcgtgacccagttcgataacacgcaggttgggacgctcgcgctgagtcttaccttcatcagatccaccatgtccctcgtaatggcatggaggacaattatggccgtgctgttcgtggttactttgattcccctctgcaggactagctgtctgcagaagcaaagtcactgggtagagatcacggcgctgatcctaggggctcaagccctgcccgtctacctgatgaccctcatgaagggggcctcacggcggtcctggcctcttaacgaaggaatcatggctgtggggctggtatcactcctgggctccgcccttctcaagaatgatgtcccgctggccggccccatggtggccgggggcctgcttctagccgcgtacgtgatgagcgggtcgtctgctgacctcagcctcgagaaggcggccaacgtccagtgggacgagatggccgacatcacgggttccagtcctatcatcgaagtaaagcaggacgaggatggttctttcagcatccgcgatgtggaggaaaccaatatgatcacactgctggtcaagctcgcgcttatcactgtgtccggactgtatcccttagcgatccccgtgactatgaccctgtggtatatgtggcaagtgaaaactcagcgcagcggtgccctgtgggatgtgcccagcccggccgctacccagaaggcggcactaagcgagggggtgtaccggatcatgcagcgtggactcttcggaaaaacccaggtaggcgtggggatccacatggagggcgtgttccatacgatgtggcacgtcacccggggctccgtgatttgtcacgaaacagggcgcttggagccatcatgggccgacgtccgcaacgacatgatctcttacggcgggggttggaggctaggcgacaagtgggataaggaggaggacgtacaggtgctggccatcgagccgggcaagaatcctaagcacgtgcagaccaagcccggactgtttaagacgctcgcaggggagatcggcgcagtcaccctggatttcaagcctgggaccagcgggtcgcctatcatcaatcgcaagggcaaggtgataggactgtacggaaatggggtggtcaccaaaagcggtgactacgtgagcgccatcacgcaagcagagcggatcggtgaaccagactacgaggtggacgaggacatcttcagaaagaagcgattaaccataatggatctacaccccggcgccgggaagacaaagcgcatcctcccgagcatcgtcagggaggcgctgaagcgccggctacgcaccttgattctggcccccacccgtgtcgtggccgccgaaatggaggaggccctccgcgggctgcccatacggtatcaaacccccgcggtgaagtccgagcacaccggcagggaaatcgtggacctaatgtgccacgctacgttcacgacacggcttctaagcagcactcgggtaccgaactacaacttgatcgtcatggatgaagcccacttcaccgacccgtcctcagtggccgcccgcgggtacatctcgactcgcgtcgaaatgggtgaggctgccgccattttcatgaccgccacccctcccggggccactgacccgtttccgcagagcaattctcccatcgaggacatagagcgggagatcccggagcgcagttggaatacgggcttcgactggatcaccgactaccaaggcaagaccgtatggttcgtgccatccatcaaggcggggaacgacatcgccaactgtttgcgtaagagtggtaagaaggtgatacagctgtccagaaaaaccttcgacacggagtacccgaaaaccaagctgaccgattgggactttgtggtcaccacggacatcagcgagatgggggcaaactttagagccggccgggtgatcgacccccgccgttgcctcaagccagtgattctgaccgacgggcccgagagagtcatcctggcaggccccatccccgtcacccccgcaagtgcagctcagcgtcggggccggatcgggcgcaaccctgcacaggaggacgatcagtatgtgttcagtggtgaccccctaaagaatgacgaagatcacgcgcactggaccgaggcgaagatgctccttgataacatttacacgcccgaggggatcatccccactctctttggacctgagcgggagaagacccaggccatagacggcgagttccgcctacgtggggagcagcgcaaaaccttcgttgaattgatgcggcgcggtgacttgcccgtgtggctgtcctacaaggtggccagtgctgggatatcgtacaaggatcgcgagtggtgctttacgggcgagcgcaacaaccaaatcttggaagagaacatggaggtcgagatctggacccgggagggggaaaagaaaaagctccgcccccgttggctagacgcgcgcgtatacgccgacccaatggccctgaaggattttaaggagttcgcaagcggccgtaaatccatcaccctcgacatcctcaccgagattgcctctttgccaacctacctctcttcacgggccaagctggccctggacaacatcgtaatgttacacacgaccgagcgcggcggccgcgcctaccagcacgccttaaacgagcttcccgagtcacttgagacattgatgctggtggcattactgggagccatgacggccgggatcttcttattcttcatgcagggtaaggggatcggcaaactatccatgggcctgatcaccatcgctgtggcgtcggggctgctctgggtggcggagatccagccacagtggatcgcagcctctatcatactagagttctttctcatggtgctcctgattcccgagcccgaaaagcagaggaccccacaagataatcagctcatctatgttattctgaccatcttaaccatcatcggcctgatcgcggccaacgaaatggggctcatcgagaaaacaaagaccgacttcggattctatcaggtaaagaccgaaaccaccatcctggacgtggacctgcgcccagcgtcagcctggacattatacgccgtcgctactacaatcctgacgccgatgctgcgccacacaatcgagaatacatctgctaacttgtcacttgcagccatagccaatcaggcagccgtcctgatggggcttggcaagggctggcccttgcacaggatggacctgggggtgcccttactcgcgatgggctgttactcacaagtaaaccccaccacgctgaccgcgtcattagtcatgctgttagtccactacgccataatcgggccgggactccaggccaaagcaaccagagaagcccagaagaggacggccgccggcatcatgaagaaccccacggtcgacgggatcaccgtgatagacctggagcccatatcttatgaccccaaattcgagaaacagcttggccaggtgatgttgctagtcctttgcgccgggcagcttctgctcatgcgaaccacgtgggcgttctgtgaggtgctgacattggccacagggcccatcctgactctgtgggaggggaatcccggccggttctggaacactacgatagccgtgagcacggccaacatcttccgcggctcctatctggccggagcaggactagccttctccttaatcaaaaacgcgcaaacaccccgacgcgggaccggaacgacaggtgagaccctgggcgagaagtggaagcgacagctgaactcgctcgatcgcaaggagttcgaggagtacaagcggagcggcatcctggaggtcgaccgcaccgaggccaagtccgctttgaaggatgggagcaagatcaagcacgctgtgtcgcgtggcagcagcaagatacgctggatcgtagagcgtgggatggtcaagcccaaggggaagattgtcgacctcgggtgtggacgcggcgggtggagttactacatggcaacgctgaagaacgtgacggaagtcaaagggtacaccaaaggagggccggggcacgaggagccgatccccatggccacctacgggtggaacctggtgaagctacacagcggcgtggatgtcttctataagccgaccgaacaggtggatacgctgctctgtgacataggagagtccagctccaatccgaccatcgaggagggcaggacgctgagagtgttgaaaatggttgagccctggctgtcatccaagcccgagttctgcattaaggtgttgaacccgtacatgccgacggtgatcgaagaactcgagaagttacagagaaaacacggcggcaacttagtccgttgcccactcagccgcaactccacgcacgagatgtactgggtgagcggcgcgtctgggaacattgtcagcagcgtgaacacgacctcaaagatgctactgaatcgcttcaccactcgacatcggaaacccacttacgagaaagacgtggatctcggcgcgggaacccgttcggtcagcaccgaaacggagaaacccgacatgactatcatcggccggcgccttcagaggctgcaggaggagcacaaggagacctggcattatgaccaagagaacccgtacagaacatgggcctaccatgggtcatacgaggcgccctcaacgggatccgctagctcgatggttaacggagtggttaagctcctaaccaagccctgggacgtgatcccgatggtgacccagctggccatgacagatacgactccgtttggacaacagcgggtctttaaggaaaaagtggacaccagaacaccccagccgaagccgggaacgcggatggtgatgaccacaactgccaactggctctgggccctgctggggaagaagaaaaatcctaggctctgcacgcgagaagagttcatcagcaaggtccgctcaaacgcagccatcggagccgtattccaggaggagcaaggatggacctccgcgagcgaggccgtgaacgacagtcgcttttgggaacttgtggacaaagagcgcgctctgcaccaagagggcaagtgcgagtcgtgcgtgtataacatgatgggcaagcgcgagaagaagctcggagagttcggccgagccaaggggtcccgagcgatctggtacatgtggctgggcgcgcgcttcctggagttcgaagcgcttggatttttaaacgaggaccattggttcggccgcgagaactcgtggtccggcgtggagggagaaggcctgcacaggctcgggtacatcctggaggagatcgacaaaaaggatggcgacctgatgtacgcggacgacaccgccggttgggacacccgtatcactgaggacgatttacagaatgaagaactaatcaccgagcagatggctccccatcacaagatactggccaaagctatcttcaagttgacgtatcagaataaggtagtgaaggtgctgaggcccacccctcgcggcgcggtgatggacatcatcagtcggaaggaccaacgcggctccggacaggtgggcacctacggactaaacacgttcacaaacatggaagtacaactcatccgacagatggaggccgaaggcgttataacccaggacgatatgcagaacccaaagggattgaaggagcgcgtggagaagtggcttcgggagtgcggggtagaccgcctcaagcggatggctatctcaggcgacgactgtgtcgtgaagcccctagacgagcgcttcgggacatctctgctgttcctaaacgacatgggtaaagtgcgcaaggacattccccagtgggagccgtccaagggctggaagaactggcaagaagtacccttctgcagccaccatttccacaagattttcatgaaggatgggagaagcctggtggtgccctgtagaaaccaggatgaattgattggccgcgcccgaatctcccagggggccggctggtccctgcgagagaccgcctgcctaggaaaggcatacgcgcagatgtggtccctaatgtacttccaccgtcgggacctgcggttggcgtcgatggccatctgcagcgcagttcccaccgagtggctcccgacctcccgcaccacgtggtcgatccacgcccaccaccaatggatgaccaccgaggatatgctgaaggtgtggaaccgcgtgtggatcgaagacaaccccaatatgatcgacaagacccccgtgcatagttgggaggacatcccctacctgggaaagcgggaagacctctggtgcgggagcctgatcggcctgagtagccgcgcgacctgggccaagaacatccacacagccataacccaggttcggaacctgatcggcaaggaagagtatgtggactacatgccggtcatgaagcggtactccgcgcctagcgagagtgagggtgtactgtag

SEQ ID NO: 26267 - RNA, 9867 nt, synthetic construct
  misc_feature 1..9867: note = derived and/or modified CDS sequence (opt11) from DENV-4__JN819409__SS-prME
  source 1..9867: mol_type = other RNA
tctaccatcactctactatgtctgatcccaaccgtgatggctttccacctgtctacccgcgacggggagcccctcatgatcgtggcaaagcacgagcgggggcggcctctgctgtttaagacgaccgaaggcataaacaaatgcacactcatcgctatggacctgggggagatgtgcgaggacaccgtgacctacaagtgccccctcttagtgaacaccgaacccgaggacatcgattgctggtgtaacctgaccgccacctgggtgatgtacgggacttgcacccaatcaggggagcggcgcagggagaagcgctccgtggccctgaccccgcatagcgggatgggcctcgagacccgggccgagacctggatgtctagtgagggggcctggaagcacgcgcaaagggtggaatcctggatactgcggaacccaggcttcgccctgctcgccgggttcatggcgtacatgattggccagaccgggatccagcgcacggtcttcttcgtcttgatgatgttggtggcccccagttacgggatgcggtgcgtcggcgttgggaaccgagacttcgtggaaggcgtctccgggggcgcctgggtggacctcgtgctcgagcatggcgggtgcgtcaccaccatggctcaagggaagcccaccctcgatttcgagctcacgaaaaccactgctaaggaggtggctctgctgcggacctactgcatagaggcgctcatctcaaacatcaccaccgccacccgctgcccgacccagggggagccctacctgaaggaagaacaggaccagcagtacatctgtcggcgcgacgtggtcgaccggggatggggaaacggctgcggcctgttcgggaagggcggggtggtgacgtgcgctaagttttcctgcagcggcaagatcactgggaacttagtccagatcgagaacctagaatacaccgtggtggtcacagtccacaacggcgacacgcacgccgtgggtaacgacactagcaaccacggggttactgccacaatcacgccccgaagcccctccgtggaggtcaagctcccggactacggcgagctcacactggactgcgaaccccggagcgggatcgacttcaacgagatgatcctgatgaagatgaagaagaagacctggctagtgcacaaacaatggttcctggacctgcccctcccctggaccgcgggcgcggacacctccgaggtgcattggaactacaaggagcgcatggtgacgttcaaggtcccgcacgccaagcggcaagacgtgaccgtactcggttctcaggagggagccatgcattccgccctggcgggcgccaccgaggtggacagcggggatggcaaccacatgttcgccgggcaccttaaatgcaaggtccggatggaaaaacttcgcatcaaggggatgagctacactatgtgcagcggtaagttctcaatcgacaaggagatggccgagacgcagcacgggacgaccgtcgtgaaggtcaagtacgagggagccggggcgccctgcaaggtccccatcgaaatccgggacgtgaacaaagagaaggttgtcgggcgcgtgatctccagcacgccgctggccgagaatacgaacggggtgaccaatatcgagcttgagcctcccttcggagactcctacatcgtcatcggtgtgggaaattcggcccttaccttacattggttccgcaaaggctccagcatcgggaagatgtttgagtccacgtatcgcggcgccaagcggatggcgattctcggggaaacggcctgggatttcggcagcgtcggcgggctgttcacctcactaggcaaggcagtccaccaggtttttggttccgtgtacaccacgatgttcggcggggtctcctggatgatccgcatcctgataggcttcctggtgttatggatcggcacaaattctcgaaacacctccatggccatgacatgtattgccgtaggagggatcaccttattcctcggcttcacggtacaggcggacatgggatgcgtggtgagctggtccgggcgcgagctcaagtgcggcagcggcatcttcgtcgtcgacaacgtccacacgtggaccgagcagtacaagttccagcctgagtctcccgcccgactggcttcggccatcctcaacgcccacaaagacggggtctgtggcatccggagcaccacgcggctggaaaacgtgatgtggaaacagatcaccaacgaactgaactacgtgctctgggaaggcggccacgacctgaccgtcgtagcgggcgacgtgaagggggtcctgacgaagggaaagcgcgccctaacgcctcccgtgtccgacctgaagtacagctggaagacctgggggaaggccaagatcttcacccccgaggccaggaactccaccttcctaatcgacggtccagacacgagcgagtgcccaaacgaacgccgggcctggaactccctcgaggtggaagactatggtttcggcatgttcacgaccaatatctggatgaagttccgcgaagggagctccgaagtctgcgatcaccggctgatgagcgcggcgatcaaggaccagaaggccgtgcatgccgatatggggtactggatcgagtcctcaaagaaccagacctggcaaatagagcgcgcttcgcttattgaggtgaagacgtgcctctggcccaagacccacaccctatggagcaatggcgttctggaatcccagatgctcatccctaagtcttacgccggccccttctcccaacacaactaccggcagggctacgcaacccagacagtggggccttggcacctgggcaaactggagatcgactttggcgagtgccccggtaccaccgtgaccatacaggaggactgtgaccaccgcggcccctctctgcgcaccacgacagcttccgggaagctagtcactcagtggtgctgccgatcgtgcacaatgccgcctctacgcttcctcggagaggacgggtgctggtatggaatggagattagaccactgagcgagaaggaagagaacatggtgaagtcccaggtcacggccggccaagggacctcggagactttctccatgggtctgctctgcctaaccctcttcgtggaggagtgcctccgacggcgcgtgacgcggaagcacatgatcttggcggtcatcatcacactgtgcgcgatcatacttggaggcctgacctggatggacctgctacgcgctctgattatgcttggggacaccatgagcgggcggataggtgggcaaacgcacctcgccatcatggcagtgttcaagatgtcccccggctacgtgctgggggtcttcctgagaaaactcacctcgcgggaaacggcgctgatggtgatcggcatggcaatgacaacgaccttgtccatcccgcacgatttgatggagctgatagatggtatttcattaggtctaatcttattgaaaatcgtgacccaattcgacaacactcaggtcggtaccctcgccctgtccctgaccttcatccgctccaccatgtctctcgtgatggcatggcggaccatcatggcagttctgttcgtcgtgacgcttatccccctctgtcgcaccagctgcctacagaagcagtcccactgggtggaaatcaccgcgctgatcctcggggcccaggcgctgcccgtgtacctgatgacccttatgaagggggcctcgagaagatcctggccccttaacgagggcatcatggcggtgggcctggtgagcctgctgggctcggccctgctcaagaacgacgtcccgttggccgggcccatggttgccggaggactactgttagcggcttacgtgatgtcaggatccagcgccgacctgagcctcgagaaggccgccaacgtccaatgggatgaaatggccgatatcacggggagtagcccaattatcgaggtgaagcaggacgaggacggctccttcagcattcgggatgtagaggagaccaacatgatcaccctgctggtcaagctcgcgctgatcactgtgagcggcctgtacccattagccatccccgtgaccatgaccctgtggtacatgtggcaggttaagactcagcgcagcggcgccctgtgggacgtgcccagccccgcagccacccaaaaagcggcactgtccgagggtgtgtaccggatcatgcagcgcggtctgtttgggaagacccaggtcggggtgggcatccacatggagggcgtattccacacgatgtggcacgtcacccggggttccgtgatttgccacgagaccggcagactcgagcccagctgggccgacgtacgcaacgacatgatctcctacgggggcggctggcgactcggcgacaagtgggacaaggaggaggacgtacaggtgctggccatagagccgggtaagaaccctaagcacgtacaaacaaagcccgggctgtttaagaccctcaccggcgagattggggccgtcaccctggacttcaagcccggaaccagcggctcccctatcatcaaccgcaaggggaaggtcatcggattatacgggaacggcgtggtgaccaagagcggggactacgtgtccgcgatcacacaggccgaacggatcggcgagcctgactacgaggtggacgaggacatcttccgtaagaagcgcctcaccattatggacctgcacccgggggccgggaaaacaaagcgcatcctgccgtctatcgtccgggaggccctgaagcgccggcttcggacccttatcttggcgccgactcgggtggtggcagcagaaatggaggaggccctccgtggactgccaatacggtaccagacccccgccgtcaagtcggagcacacagggcgcgaaatcgtggacttaatgtgccacgctacgttcaccacccggctcttgtcgtcgactcgcgttccgaattacaatctgatcgtaatggacgaggcccacttcacggaccccagcagcgtggccgccaggggttacatctccacccgggtcgagatgggggaggcagcggctatcttcatgaccgccacgccgccgggcgctaccgacccgttcccccagagcaactcccccatcgaggacattgagcgggagatacccgagcgcagctggaacaccggttttgactggataaccgactaccaggggaagacagtgtggttcgtaccgtccatcaaggccggcaacgacatcgccaactgtctgagaaagagcggtaaaaaggtgatccagctgtcccggaaaacgttcgacacagagtatcccaagaccaagttgaccgactgggatttcgtggtgacgaccgacattagcgaaatgggtgcgaacttccgcgctgggcgggtcatcgaccccaggcggtgcctcaagcccgtgatactgaccgacggcccagagcgcgtgatcttggccggtcctatccccgtcacccccgcgtccgctgcccaacggcgaggacggataggtcgcaacccggcccaggaggacgaccagtacgtcttctcgggtgaccctctcaagaacgacgaggaccatgcccactggacggaggctaagatgttactggacaacatctacactcccgagggcatcattcccaccctcttcggccccgagcgggaaaagacgcaggccatcgatggtgagttccgtctccggggcgagcagcgcaagacgtttgtggagctgatgcggcgcggggacttgcccgtctggctgtcctacaaggtggccagcgccggcatctcctacaaagaccgggagtggtgcttcactggggagcgcaacaaccagatccttgaggagaacatggaggtggagatctggacacgagagggcgagaagaagaagctccgtccccggtggctcgacgcccgcgtctacgcggaccccatggccctgaaagacttcaaggagttcgctagcggacgcaagtccatcacattggacatcctgaccgagattgccagcctgccgacgtacctctccagcagagccaagctggcgctggacaacatcgtgatgctccataccaccgagcgcggtggccgggcctatcagcacgccctgaacgaactcccggagtccctcgagaccctaatgctggtggccctcctgggggcgatgaccgcaggcatctttctgttcttcatgcaggggaagggtatcggcaagctaagcatggggcttatcaccatcgccgtcgcttccggcctactctgggtggccgaaattcaaccccagtggatagcggcctccattatcctggaatttttcctgatggtgttactgatacctgagcccgagaagcagcgcacgccccaggacaaccagttaatttacgtcatactgaccatcctgacgatcatcgggctgatcgccgccaatgaaatgggcctcatagagaagaccaagaccgactttgggttctatcaggtgaagactgagaccaccatcctcgacgtggacctgcggcccgccagcgcgtggaccctctacgctgtcgccaccactatcttaaccccgatgctgaggcataccatcgagaatacctcagcgaatctctccctggccgcgatcgccaaccaggccgccgttctgatgggcttaggcaaggggtggccactgcaccggatggacctgggcgtgcccctcctggccatgggttgctactcccaggtcaaccccacgactctgaccgcaagcctggtgatgctgctggtgcactatgcaatcatcggtcctggactccaggccaaggccacccgtgaagcgcagaagagaacggccgccgggatcatgaagaatccgaccgtggacggcatcactgtcatcgacctggaacccatctcctacgaccccaagttcgagaagcagctcggccaggtgatgctcctggtcttatgcgcgggccagctcctgttgatgcgcacgacatgggccttctgcgaagtgctcaccctggcgaccggtccgatactgacgctctgggagggcaaccccggccggttctggaacaccaccatcgccgtaagcaccgcgaacatcttccgcgggtcctacctcgccggcgccgggttagcgttcagcctcattaagaacgcccaaacgcctcggcgcggtaccgggaccaccggagagaccttgggggagaagtggaagcggcagttaaactcgctcgaccgcaaggagttcgaagagtacaagcggagcgggatcctggaggtggatcgcacagaagccaagtccgcccttaaagacggcagcaagatcaaacacgccgtgtcccgggggtccagtaagatccgctggatcgtagaacggggcatggtcaagcccaagggaaaggtcgtggatcttggatgcggccgcggcggttggagctattacatggcaacgctgaaaaacgtcacggaagtgaaggggtatacgaagggaggtccgggtcatgaggagccaatccccatggccacctatgggtggaacctagtgaagctccactccggagtggacgtgttctacaagccgacggagcaggtcgacaccctgctgtgcgacataggcgagagcagctccaaccccaccatcgaagaggggcgcaccctccgggtcctgaagatggtcgagccctggttaagttccaagcccgagttctgcatcaaggtgttaaatccctacatgcctacggtcatcgaggaactggagaagttacagcgcaagcacgggggcaacctggtgcggtgccccttaagccgcaactccacccatgagatgtactgggtctccggggcctcgggcaatatcgtgagctccgtgaacaccaccagcaagatgctgctgaaccggttcacgacgagacaccggaagcccacctacgaaaaggatgtcgacctcggggccggcacgcgctccgtaagcacggagaccgagaagccggacatgacaatcatcgggcgacggctgcagcgactgcaagaggagcacaaggagacctggcactacgaccaggagaacccgtaccgcacgtgggcataccacggctcctacgaggccccttcgaccggctccgcatcctccatggtgaacggggtcgtgaagctcctgaccaagccctgggatgtgatcccgatggtcacccagctcgccatgacggacacgacgcccttcggccagcagcgggtcttcaaggaaaaggtggatacccgcacaccgcagcctaagccgggaacccggatggtcatgactaccacggcaaactggctgtgggcacttctgggtaagaagaagaatcccagactctgcaccaaggaggagttcatctcgaaggtacggtccaatgccgccatcggcgccgttttccaagaggagcagggctggactagcgccagcgaggcggtcaacgactcacgcttctgggagctggtggacaaggagcgggcactccatcaggagggcaagtgcgaatcgtgcgtgtacaacatgatggggaagcgcgagaagaagctcggcgagttcgggcgcgccaaaggctcacgggccatctggtacatgtggctgggagcccgcttcttggagttcgaggcgctcggtttcctgaacgaagaccactggttcggccgcgagaacagctggtccggagtcgagggtgaggggctgcatcgcttaggatacatactggaggagatcgacaagaaagacggcgacctgatgtacgctgatgacacagctggctgggacacgcgcatcaccgaggatgacctgcagaacgaggaactcattaccgagcaaatggctccccaccataagatcttggcgaaagcaatcttcaagttaacctaccaaaacaaggtggtgaaggtcctgcgccccaccccgagaggggctgtgatggatatcatcagccgaaaagaccagaggggttccggccaggtagggacgtatggtctgaacaccttcacaaacatggaggttcagctcatccgccagatggaggccgagggcgtgatcacccaggacgatatgcagaaccccaaggggctgaaggagcgggtggagaagtggttacgcgagtgcggcgtcgaccggctcaagcgcatggcaatctcgggggacgactgcgtggtaaagcctctggatgagcggtttggcacttccctcctgttcctaaacgacatggggaaggtccgcaaggacatcccccaatgggagccttcaaagggctggaagaactggcaggaagtacccttctgctcacaccatttccataagatcttcatgaaggacggccgttcgcttgtcgtcccctgccgcaaccaagacgagctcatcgggcgggcacgcatttcccagggagctgggtggagccttcgcgaaacagcctgcctgggcaaggcctacgcacaaatgtggtccctaatgtacttccaccggagagacctgcggctggcgagcatggctatatgctccgccgttccaaccgagtggtttccaaccagccgcaccacatggtctatccacgcccatcaccagtggatgacaacggaggacatgctaaaagtctggaaccgggtctggatcgaggacaacccgaacatgacggacaagacgccgatccactcctgggaagacatcccctatctggggaagcgcgaggacctgtggtgcggcagcctcataggcctgtccagtcgggcaacctgggcgaaaaatatccacacggccataacccaggtacgaaacctcatagggaaggaggagtacgtggactacatgccggtcatgaagcgctactccgcccccagcgagtccgagggcgtgctctga

SEQ ID NO: 26268 - RNA, 9867 nt, synthetic construct
  misc_feature 1..9867: note = derived and/or modified CDS sequence (opt11) from DENV-4__FJ639742__SS-prME
  source 1..9867: mol_type = other RNA
agcaccatgactctgctctgtctgatccccacggccatggccttccacctctcaacccgcgacggcgaaccgctcatgatcgttgcgaaacacgaacggggtcgccctttactgttcaagaccactgaaggtatcaacaagtgcacgctcattgctatggacctgggggaaatgtgcgaagacacggttacctataaatgtcccctgctcgtcaacaccgaacccgaagatatcgactgctggtgcaaccttacgagcacctgggtgatgtacggaacttgcacccagtccggggaacggcgccgtgagaagaggagcgtcgcgttaactccgcattccggcatgggactcgagacgagggccgagacttggatgagctccgagggggcctggaagcacgcgcagcgcgtagagagctggatcttgcgtaaccccggcttcgccctgctcgccggtttcatggcgtacatggtggggcagaccgggattcagagaacggtcttcttcgtgctgatgatgctggtggctccctcctacggcatgcggtgcgtcggagttggaaaccgagacttcgtggagggcgtcagcgggggcgcctgggtagacctcgtgttggagcacggcgggtgcgtcactaccatggcccaagggaagccaacgctggacttcgagctcacgaaaaccacagccaaggaggtggcactgctgcgaacctactgcatcgaagcgctcatcagtaacatcacgaccgccacccgttgcccgacccagggggaaccctacctgaaagaagaacaggaccagcagtacatctgccggcgcgacgtcgtcgaccgcggctggggaaacggctgcggcctatttgggaagggtggggtagtgacgtgtgctaagttcagctgcagtggcaagatcaccggtaacctagtccaaatagagaacctggagtacacagtcgtggttacagtgcataatggtgacactcacgccgtcggtaacgacacctcgaaccacggggtgaccgcgacgattaccccacgctccccaagcgtggaggttaagttgccggattatggcgagctcaccctggactgcgagccccggagcggaatcgacttcaacgagatgatcctcatgaagatgaagaagaagacgtggcttgtgcacaagcagtggttcctagacttacccctcccttggacagcaggcgccgacaccagcgaagtgcattggaattataaggagcgcatggtcacttttaaggtgccacacgccaagcggcaagacgtaaccgttctggggtcccaggagggcgccatgcatagcgccctggcaggcgccaccgaagtcgatagcggggacggcaaccacatgttcgccgggcatctcaagtgcaaggtgagaatggagaagctcaggattaaaggtatgtcctacaccatgtgcagcggcaagttctccattgacaaggagatggccgagacgcagcacgggaccaccgtcgtgaaggtgaagtacgagggcgccggggcgccatgtaaggttcccatcgagattagggacgtgaacaaagagaaggtggtcggccgcgtgatatcaagcaccccattagcggagaacacgaactcagtaacaaatattgagctcgagccgcccttcggagacagttacattgtcatcggcgtaggcaacagcgccctgaccctgcactggttccggaaagggtccagcatcgggaagatgttcgagtccacctaccgcggggccaagcggatggcgatcctcggagaaactgcctgggattttgggagcgtaggcggcttattcacctccctggggaaggccgtccatcaggtgttcggctcggtctacaccactatgttcgggggcgtctcatggatgatccgcatactcatcgggttcctggtgctgtggattggtacgaacagcaggaacacctccatggccatgacctgcatcgccgtcggcgggatcacactgtttctcggcttcacggtacaggcggacatggggtgtgtggtgagctggagtggtcgcgagctaaagtgtgggagcggcatcttcgtcgtggacaacgtgcacacatggaccgagcagtacaagttccagccagagagccccgcccggctagcctctgccattctcaacgcccataaagacggcgtctgtggtatccgcagcacaacgaggttggaaaacgtgatgtggaagcagatcaccaatgagttaaattatgttctttgggagggcgggcacgacctgaccgtagtggccggcgacgtgaaaggcgttctgaccaaggggaaacgcgccctgacaccgcccgtctccgacctgaagtattcgtggaagacctggggcaaggccaaaatctttacccccgaggcccggaactccacgtttctgatagacgggcccgacacgtctgaatgcccgaacgagcgccgggcttggaactccttggaggttgaggactatggatttgggatgtttaccaccaacatctggatgaaatttcgcgagggtagctccgaggtctgcgatcacagactgatgtctgcggccatcaaggaccagaaggcggtgcatgccgacatgggctactggatcgaatccagcaagaatcagacctggcaaatcgagcgcgcgtccctgatcgaggtgaagacgtgcctctggccgaagacccataccctgtggagcaacggggtcctcgagtcccagatgctcatccccaaaagctacgccggcccattctcccagcacaactaccggcaggggtacgccacccagaccgtaggcccctggcacctggggaaactggagatcgactttggcgaatgccccggcacgaccgtgactatccaggaggactgcgaccaccgcgggccctccctgcgtaccacgaccgccagcggcaaacttgtcacccagtggtgctgccggtcgtgcacgatgccgcccctccgcttcctcggggaggacggctgctggtacgggatggaaatccggccgctgtcggagaaggaggagaatatggtgaagtcccaggtcacggcaggccaaggcacaagcgaaacatttagcatggggctgctatgtctgaccctgtttgtggaggagtgcctccgacgaagagtgacgcggaagcacatgatcctggcagtcgtgatcaccctgtgcgccatcatcctcggcggccttacgtggatggacctgctccgagccctgatcatgctgggtgacacaatgagcggccggatcgggggccagacgcacctggccatcatggccgtgtttaagatgtcccccgggtatgtcctaggcgttttcctgagaaagctcaccagccgggaaaccgcgctgatggtgataggcatggccatgaccacgaccttatccatcccgcacgacttgatggaactgatcgacggaataagcctggggctaatcctgctgaagatcgttacgcagtttgacaacacccaagtggggacgttggccctgtccctgaccttcattcgctcaaccatgagtctcgtgatggcctggcggaccatcatggctgtcctgttcgtagtcactctgatccccctctgtcgcaccagctgtctgcaaaagcagtcccactgggtagaaatcaccgcgctgattctcggtgcccaggccttacccgtgtacctaatgaccttgatgaagggggccagccggcgctcctggccactcaacgagggtatcatggcggtggggctggtctcactcctgggctccgccttgctgaagaacgacgtgcctctagcaggccccatggtggccgggggcctgctgttagccgcgtacgtaatgagcgggagctccgccgacctgagcctcgagaaggccgctagcgtgcagtgggacgagatggccgacatcactggcagctcccccattatcgaggtgaaacaggacgaggatgggagcttctccatccgggatgtcgaggagactaacatgatcaccctgctggtgaaactagctttaattaccgtgagcggactgtacccccttgccatcccggtcacgatgaccctgtggtatatgtggcaagtgaagacccaacgttctggcgcactatgggacgtgcccagccccgctgccacgcagaaggcggccctctccgagggggtataccggatcatgcaaaggggcctgttcggtaagacccaggtgggcgtcgggatacatatggagggagtctttcacacgatgtggcacgtgacccgcgggagcgtgatctgccacgagaccggacgcctcgagccctcctgggccgacgtccgcaacgatatgatcagctacgggggcggctggcggctcggcgacaagtgggacaaggaggaggacgtgcaagtgttagcaatcgagccggggaagaaccccaagcacgttcagaccaagcccggtctgttcaaaacgctcaccggggaaatcggcgcagtgaccctggattttaaaccggggacctctggcagcccgatcattaatagaaaaggcaaggtgatcgggctgtacggcaacggggtcgtaacgaaatccggcgactacgtgtcagcgattacccaagctgagcggattggggagcctgattacgaggtagacgaagacatcttccgcaagaaacggctcaccataatggacctgcacccgggcgccggtaagaccaaacgcatactgccctctatcgtacgggaggcccttaagcgcagactccgcacgctgatcttggcgcccacacgggtggtagccgccgaaatggaggaggccctcagggggctccccattcggtaccagacccccgccgtaaagagcgagcacactggccgcgagatcgtggacctgatgtgccacgcgacgtttactacccggctgcttagctccacccgcgtccccaactacaacctgatcgtaatggacgaggcccacttcacggacccctcctccgtcgccgcgaggggctacatctcgacgcgcgtggagatgggcgaggccgcggcgatcttcatgaccgcgacgcctcccggggccaccgacccgttcccgcagtccaattcgcccatcgaggatatagagcgggaaatccccgagcgctcgtggaacacgggcttcgattggatcaccgactatcagggtaagacggtgtggttcgtcccgagcatcaaggccgggaacgatatcgctaactgcctccgcaaaagcggcaagaaagtcatacaactgagccgtaagactttcgacaccgaataccccaaaaccaagctgaccgattgggatttcgtggtcacgaccgacatatcggagatgggggccaacttccgcgccggccgcgttatagaccccagacggtgcctcaagcccgtgatcctgaccgacgggccggagcgcgtaatcctggccggccccatccccgtgaccccagcttcggccgcccagaggcgcggccggatagggcgcaacccggcccaggaggacgaccagtacgtgttctccggcgaccccctcaagaacgacgaggaccacgcccactggaccgaggcgaagatgctgctggacaacatctatacgccggaaggtatcatccctaccttgttcggcccggagcgggaaaagacccaggccatagacggcgaatttcgtctgcgtggggaacagcggaagacgttcgtggagttaatgcggcgcggagacctccctgtgtggctcagctacaaggtggcctccgccgggatcagctacaaggatcgggaatggtgcttcactggcgagcgcaacaaccagatcctggaggaaaacatggaagtcgagatctggacccgagagggggagaagaagaaacttcgccccagatggttagacgcccgcgtgtacgccgaccccatggccctaaaggactttaaagagttcgcctccgggcgcaagagcatcacgctcgacatcctgacagagatcgcatcccttccgacgtacctttcaagccgagccaaacttgctctcgacaacatcgtgatgctccacaccaccgagcgcggaggacgggcgtaccagcacgccctgaatgagctgcctgagagcttagaaaccctgatgctggttgcccttctgggcgcgatgacagccggtatcttcctgttcttcatgcaaggcaagggcatcggcaagttaagtatgggcctgatcacaatcgccgtggcgtccgggctgctctgggtggccgagattcagccccaatggatcgctgcctcgatcatcttagagttcttcttaatggtcctcttaatcccagagcccgaaaagcagcgcacccctcaggacaaccagctgatttatgtgatcctcactatcttgacgataatcggcctcatcgccgccaacgaaatgggtctcatcgagaagacgaagaccgacttcggcttttaccaggtgaaaaccgagacgaccattctcgatgtcgatctgcggcccgcgtccgcgtggaccctatacgccgtggccaccacgatcctgaccccgatgctccgccacacgatcgagaacactagcgccaacttgtccctggccgcgatcgcaaaccaggccgccgtgctgatggggctcggcaagggctggcccctgcaccggatggacctgggtgtccccttgttggccatgggttgttatagccaggtgaaccccacgactctgaccgcgtccctggttatgctgctcgtccattacgccatcataggtccgggcctccaggccaaggccacccgcgaagcgcagaagcggacggcagcgggtatcatgaagaaccctaccgtggacgggatcacagtgatcgaccttgagcccatctcctacgatcccaagttcgagaagcagctgggtcaggtcatgctcctggtactgtgtgccggtcagctcctattgatgcgcaccacatgggccttttgcgaggtgctcaccctggctaccgggcccatcctaaccctctgggagggtaatcccggccggttctggaacacgaccatagccgtctccaccgcaaacatcttccgcggaagctaccttgcaggggccgggttagccttttcccttatcaagaacgcccagacgccccggagggggacgggcaccaccggggagaccctgggggagaagtggaagcggcagttgaacagcctcgaccgcaaggagttcgaggagtacaagagaagtggcatcctggaggtggaccgcaccgaggctaagagcgccctgaaggacgggtccaagataaagcatgccgtcagccggggcagtagcaagatccgctggatcgtcgagcgcgggatggtgaagcccaaaggcaaggttgtcgacctcgggtgcggtcggggcggctggtcctattacatggcgacgctcaagaacgtgacggaggtgaagggctacaccaagggaggcccggggcacgaggagcccatcccaatggccacctatggctggaatctcgtcaaactccactccggcgtggacgtcttctacaagcccacagagcaggttgacacactgctgtgtgacatcggggagagctcctcgaacccgacgatagaggagggccgcaccctccgggtgctgaagatggtggagccctggctgtccagcaagcccgagttctgcatcaaagtccttaacccctacatgccgacggtgatcgaggagttagagaaactgcagcgcaagcacggtggcaacctggttcggtgccccctcagtcgcaacagcacccatgagatgtactgggtctccggcgcgtcggggaacatcgtgtcgagcgtcaacaccacctccaaaatgctgctgaaccgattcacgacacgccaccggaagccaacctacgaaaaggacgtggacttgggggctgggacgaggagcgtgtccaccgagaccgagaaaccagacatgactatcattgggcggcgcctacagcggctgcaagaggagcacaaggagacctggcactacgaccaggagaacccgtaccgaacgtgggcgtaccacgggagctatgaggccccctccaccgggtctgccagcagcatggtcaacggcgttgttaagctcctgactaagccctgggacgtcatcccgatggtgacccagctggccatgacggacaccaccccattcgggcagcaacgggtgttcaaggagaaagtcgacactcgcacaccacagcctaagccgggcacccgaatggtgatgaccaccacggccaactggctctgggcgctgctgggaaagaagaagaaccctcgcctatgcaccagagaggagttcatcagtaaggtgcgctccaacgccgccatcggcgccgttttccaggaggagcagggttggaccagcgcctccgaagctgtgaacgacagccggttctgggagcttgtcgacaaggagcgcgcactgcaccaggagggcaagtgcgaatcctgtgtctacaacatgatgggcaagcgcgagaaaaagctcggggagttcggacgggccaagggaagccgcgcaatctggtatatgtggctgggcgccagattccttgagttcgaggcgctcggattcctgaacgaggaccactggttcggccgcgagaactcctggagcggcgtagaaggggagggcttacaccggttggggtacatactggaggagatcgacaagaaggacggagacctgatgtacgccgacgacacggccggctgggatactcgcatcactgaggatgacttacagaatgaggagctgatcacagagcagatggctccccatcacaagatcctggcgaaggcaatcttcaaactcacctaccagaacaaggtggtcaaggtgctgcggcccaccccgcggggagccgttatggacatcatctcccggaaggaccaacgcggatcagggcaggtcggcacgtacgggctcaacaccttcaccaacatggaggtgcaattaattcggcagatggaggctgagggcgtgataacccaggacgacatgcagaacccaaagggcctgaaagagcgcgtggagaagtggctgcgggagtgcggggtggaccgcttaaaacggatggctatttccggagacgattgcgtggtcaagccactggacgagaggttcggcacgtctcttttattcctgaacgatatgggtaaggtgcggaaggacattccccaatgggaaccgtccaaggggtggaagaactggcaagaagtacctttctgttcacaccatttccacaagattttcatgaaggatgggcgctccctggtcgtcccctgccggaaccaggacgaacttatcggccgcgcgcgcatcagccagggagcgggctggtccctgagggagaccgcttgcctggggaaggcctacgcccaaatgtggagcctcatgtacttccatcgccgggaccttcgtctggcgtccatggccatttgctccgcagtgcccacagaatggttcccgacaagccgcacgacctggtcgatccatgcccaccaccaatggatgaccactgaggacatgctcaaggtctggaaccgcgtgtggattgaggacaacccaaacatgatcgataagacgcccgtccattcatgggaggacataccttacctggggaagcgggaggacctgtggtgcgggtccctcatcggcttaagctcccgcgcaacctgggctaagaacatccataccgccatcacccaggtccggaacctaatcggaaaggaggagtacgttgactacatgccggtgatgaagcgctatagcgcgcccagtgagagcgagggggtcctctga

SEQ ID NO: 26269 - RNA, 9867 nt, synthetic construct
  misc_feature 1..9867: note = derived and/or modified CDS sequence (opt11) from DENV-4__FJ639745__SS-prME
  source 1..9867: mol_type = other RNA
agcaccatgaccctgctctgcctgatccccactgccatggccttccacctgagcacccgggacggcgaaccgctcatgattgtggcgaagcacgagcgggggcgcccgctgctgttcaaaaccacagagggtattaacaagtgcacgttaatcgccatggacttaggggagatgtgcgaggacacagtcacatacaagtgcccgctgttggtgaacaccgaacccgaggacatcgactgctggtgcaaccttacgagcacctgggtgatgtacggcacctgcacccagtccggcgagcggcgccgggagaagcgctccgtcgccctgactccacactccggcatgggactcgagaccagggccgaaacctggatgagctccgaaggagcctggaagcacgcgcagcgcgtggagagctggatcctccgaaacccaggattcgcgctgctcgccgggttcatggcctacatgatcggccagaccgggatccaacgcacagtgtttttcgtgctgatgatgctcgtggccccctcctacggtatgcggtgcgtgggggtcgggaaccgggactttgtcgagggcgtcagcgggggcgcatgggtcgacctggtgttagagcacggcgggtgtgtgactaccatggcccaaggcaagccaaccctagacttcgagctcacgaagaccacagccaaagaggtagcactgctgcggacgtattgcatcgaagcgcttatctccaacatcacgaccgccaccagatgtccgactcagggggagccttaccttaaggaagagcaagaccagcagtacatctgtaggcgcgatgtggtagaccggggctgggggaacggatgcggtttattcggtaagggcggagtcgtgacgtgcgccaagtttagctgttccggcaagatcaccgggaacctcgtccagatcgaaaacctagagtatacagtcgtggtgaccgttcacaatggcgacacgcacgccgttggcaatgacaccagcaaccacggggtcacggccacgatcacacccagatccccctccgtggaagtgaagctcccagactacggcgaattaacgctggattgcgagcccaggtccgggatcgactttaacgagatgatcctgatgaagatgaaaaagaagacctggctcgtccacaaacaatggttcttagatctgcccctcccctggaccgcgggagctgacaccagcgaggtgcactggaactataaggagcgtatggtcaccttcaaggtccctcacgctaagcggcaggacgtgaccgtcctcgggtcccaggagggcgccatgcatagtgccctggccggcgcaactgaagtcgacagcggggacggtaaccatatgttcgccgggcacctcaagtgcaaggtacgtatggagaagctgcgcatcaagggcatgtcatacaccatgtgcagcggtaagttcagcattgacaaggagatggctgagacgcagcacgggaccaccgtggtcaaggtgaagtacgagggagctggggcgccgtgcaaggtgccaatagagatccgggacgtgaacaaagagaaggtggtgggccgggtgatcagctccacccccttagcagaaaatacgaactctgtgaccaacatcgagctcgagccgcccttcggggactcctacatcgtgatcggcgtcggtaacagcgccttaaccctgcactggttccggaaggggtcctcaatcggcaagatgttcgagtccacctaccgcggggctaaacggatggcgatcctcggcgagactgcctgggacttcgggagcgtgggcggcctgttcacctccttagggaaagcggtgcaccaggtcttcggctcagtgtacaccactatgttcgggggcgtgtcctggatgatacgcatcctcatcgggctgctggttctgtggatcggcacaaatagccgcaacacctccatggccatgacctgcattgccgttggcggcatcaccctcttcctgggtttcacggtgcaagctgacatgggttgcgttgtatcttggtcgggcagagagcttaagtgcgggagcggcatcttcgtggtcgacaacgtgcacacatggaccgagcagtacaagtttcagccagagtcccccgcccggctcgccagcgccatactgaacgcacacaaggacggcgtatgcggaatcagaagcaccactcggcttgagaatgtcatgtggaagcagatcaccaacgagcttaactacgtgctgtgggagggcgggcatgacctgactgtagtcgctggcgacgtgaaaggtgtgctaaccaaggggaagcgcgccttaacaccgcccgtcagcgatctgaaatattcttggaaaacctggggcaaggccaagatcttcacccccgaggccagaaatagtacattcctcatcgacgggcccgacacgagcgagtgcccgaacgaacgaagagcttggaacagtctggaagtggaagactacggctttgggatgttcaccactaacatctggatgaaatttcgcgaaggcagctccgaggtgtgcgaccaccggttaatgagcgcggccatcaaggaccagaaggcggtccatgcagatatgggctattggatagagtccagcaagaatcagacctggcagatcgagcgcgccagcctcatcgaggtgaagacgtgtttatggccaaaaacgcataccctgtggtcaaacggggtgcttgaatcccaaatgctgattcccaagtcgtacgccggcccattttcccagcataactaccggcagggatatgcgacccagaccgtgggcccctggcacttgggcaagctcgagatcgacttcggcgagtgccccggcacgactgtaaccatccaggaggattgcgaccacagagggccaagcctcaggacgacaaccgcaagcggcaagctagtgacccagtggtgctgccggtcctgtacgatgccgccactgcgattcctcggggaggacggctgctggtacgggatggagatacggcctctgagcgagaaggaggagaacatggtcaaatcccaggtgacggcaggtcagggcaccagcgaaaccttcagcatggggctgctttgtcttaccctcttcgtcgaggagtgcctgcgccggcgcgtaacgcgcaagcacatgatcctggccgtggtgataacgctctgcgccataatcctgggcgggctgacatggatggacctcttacgcgccctgatcatgctcggtgacactatgtccggccggatcgggggccagacgcacctggccatcatggccgtgtttaagatgtcccccgggtacgtgctgggtgtctttctccgcaagttgaccagccgggagactgcgctgatggtaatcgggatggccatgaccacgaccctctccataccccacgatctgatggagctgatcgacggtatcagcctaggcctgatcctactcaagatcgtgacccagttcgacaatacccaggtcgggaccctggccctgagtctcaccttcatccgcagcaccatgtccctggtaatggcctggcggaccataatggccgtactgttcgtggtgactctcattcccctgtgccgcacctcttgtctgcagaaacaatctcactgggtggagatcaccgcgctcatactgggcgcccaggcactgcccgtttacctcatgaccctgatgaagggagcgtcccgtcgctcctggccgctgaacgagggcattatggcggtcgggctcgtgagcctgctgggatccgcccttctcaaaaatgacgtccccctggccggcccgatggtagccggagggctcctgctggccgcgtatgtaatgagcgggagctcggccgacctcagtctggaaaaggccgccaacgtccagtgggacgagatggccgacatcacgggctccagccccataatcgaggtaaagcaggacgaggacgggtccttctctatccgagacgtggaggagaccaacatgataaccttactcgttaagctggctctaatcaccgtatctggtctctaccccctggccattcctgtgacgatgaccctgtggtacatgtggcaggtcaaaacccaacgctcgggcgccctctgggacgtgccctcacccgctgccacccagaaggcggccctgagcgagggcgtgtaccggatcatgcagcgcggcctgttcgggaagacccaagtcggcgtgggaatccacatggagggcgtgttccacacgatgtggcacgtcacccggggttccgttatctgccacgagaccgggcgcctcgagcccagctgggccgacgtgcgcaacgacatgatatcctacggcgggggctggcggctgggcgacaaatgggacaaggaggaagacgttcaggtcctggccatcgagccgggtaagaaccccaagcacgttcagaccaagcccggcctcttcaagacgctaaccggggagatcggcgccgttaccctggacttcaagccagggaccagcggctccccgataataaacaggaagggcaaggtcatcgggctctacggcaatggggtggtcacgaagtcgggcgactacgtttctgccatcacccaggctgagcgtatcggggagcccgattacgaagtggacgaggatatatttcgaaagaagcggctgaccatcatggacctgcacccaggcgccgggaagaccaaacgtatcctgcctagcatcgtgagggaagccctcaaacgccggctgcgcacactgatcctcgcgcccacccgggtggtggccgcggaaatggaagaggccctgcgcgggctgccaatccgttaccagacccctgccgtaaagtccgaacacaccggccgcgaaatcgtggacctcatgtgccacgcgacgttcaccacccggctgttatcgagcactagagtgcccaattacaacctaatcgtcatggacgaagcccacttcacagacccctcaagcgtggccgcacgggggtacattagcactcgcgttgagatgggcgaggccgcggccatcttcatgacggccaccccacccggggccacggacccgtttccccagagcaactcccccatcgaagacatcgagcgggaaataccggagcggagctggaacaccgggtttgactggatcaccgattaccagggcaaaaccgtttggttcgtgccaagcataaaggccgggaacgacatcgcgaactgccttcgcaagagcgggaagaaagttatccagctgagtcgcaagactttcgacacagagtaccccaaaacgaagctcactgattgggacttcgttgtgacgaccgacatatctgagatgggggctaacttccgcgccggtcgggtcatagacccccgccggtgcctgaagcccgtgatccttaccgacgggccggagcgcgtgatcctcgccggcccgatccctgtcaccccggcgtccgctgctcagcggcgcggccggatcgggaggaacccagcacaggaggatgaccagtatgtgttctccggagatccccttaagaatgacgaggaccacgcgcactggacggaggcgaaaatgctgctcgacaacatatacacccccgaggggatcatccccacactcttcggcccggagagggagaagactcaggccatcgacggcgagttccgcctacggggggaacagcgcaagacgtttgtggagctcatgagacgcggcgacctgcccgtctggctgtcctataaggttgcgagcgcagggatctcctacaaggatcgggagtggtgtttcaccggcgagcgcaacaaccagatcctcgaggagaatatggaggtggagatctggacccgggagggggagaagaaaaagctgcgcccccggtggctcgacgccagagtctacgccgaccccatggcgcttaaggatttcaaggagttcgccagcggtcgcaaatccatcaccctggatatcctgaccgagattgcctcgcttccaacgtacctgtctagccgggctaaactggcgctcgacaatatcgtgatgctgcacaccaccgagcgcggcgggcgggcctaccagcacgcccttaatgagctccctgagtcgctcgagactttaatgctcgtggccctgctaggcgcgatgaccgccgggatattcctgttcttcatgcagggcaaagggatagggaagctgtccatgggcctgatcaccatcgccgtcgccagcgggttgctgtgggtagccgagatccaaccccagtggatcgcggcgtccattatactggagttctttctgatggtgctgctaatcccggagcccgaaaagcagcgtaccccccaggacaaccagctcatctatgtcatactgacgatcctaacgatcatcggcctcatcgcggccaacgagatggggctgatcgagaagaccaaaacggatttcggcttctaccaggtaaagaccgagacgaccattctggacgtagacttgcggcctgccagcgcgtggaccctgtacgccgttgcgaccacgattttgaccccaatgttgcgccatacaatagagaacacctccgccaatctatcactagccgcgatcgcgaaccaagccgccgtgctcatgggcctaggcaagggatggcccctacaccggatggaccttggggtcccattgctggccatgggctgctactcacaggtcaaccctacgacactaaccgcatccttagtgatgctgctagtccactacgccatcatcggtccgggcctgcaagccaaagctactcgggaggcccagaagcgaaccgccgccggcattatgaagaaccccaccgtcgacgggataaccgtgatcgacctggagcccatttcgtacgatcccaaattcgagaagcaactcggccaggtgatgcttcttgtcctctgtgccggtcagctgctactcatgcgtacgacgtgggccttttgcgaggtgctgaccctggctacgggcccgatcctgacgctctgggaggggaaccccggccggttctggaacacgactatcgccgtttcaacggccaacattttccgtggctcctaccttgccggagccggcctcgcgttctctctgattaagaatgcccaaacccccagacgggggacgggaaccacgggggagaccctgggcgagaagtggaagcggcagttaaattccctggaccgaaaggaattcgaggaatacaaacggagcggcatcctggaggtcgacagaaccgaggccaagtccgccctcaaggacgggagcaagatcaagcacgccgtgtcccggggcagctccaagatccgctggatcgtggagagggggatggtcaagcccaaggggaaggttgtggacctggggtgcggccggggcgggtggagctattacatggcgacactgaagaacgtcaccgaagtaaaaggctataccaaaggggggcctggccacgaggagcccatcccaatggccacttatggctggaatctcgtgaagctgcacagcggggtcgacgtgttctacaagcctacggagcaagtggacaccctgttatgcgacattggggagtccagctccaacccgaccattgaggagggccgcaccctccgggtcctaaagatggtggagccctggctgagctccaaacccgagttttgcataaaggtgctaaacccctacatgccgaccgtcatagaggagcttgagaaactgcagcgaaagcacggcgggaacctggtcagatgtcccttaagcagaaactccactcatgagatgtactgggtcagcggagcatccggaaacatcgtcagctccgtgaacaccacaagcaagatgctactcaaccggtttacgacccgccaccggaaacccacctacgagaaggacgtcgacctgggcgcgggcacccgttccgtgagcactgagaccgagaagcccgacatgaccatcatcggccgaaggttacagcggctacaggaagagcacaaggagacctggcactacgaccaagagaacccgtaccgaacgtgggcgtatcatgggtcctacgaggctcccagcaccggctccgccagctccatggtgaacggcgtcgttaagctactaaccaaaccctgggatgtgatcccgatggtcacccaactcgccatgacggacaccacacccttcgggcagcagcgcgttttcaaagagaaggtagacaccaggacgccccagcccaaaccgggcacccggatggtcatgaccacaacggcaaactggttatgggcattactcggcaagaagaaaaacccccgcctatgtacccgtgaagagttcatctctaaagtgcgctcaaacgcagccatcggcgcagtgttccaggaggagcaggggtggacttccgccagcgaggctgtaaacgactcccggttctgggagttagtggacaaggagcgcgccctccaccaggagggcaaatgtgagagctgcgtgtacaacatgatggggaagcgcgaaaagaagctgggggagttcggccgtgccaagggtagccgcgccatctggtacatgtggctgggcgcccggttcctcgagtttgaggcgctgggctttctgaacgaggatcactggttcggccgcgaaaacagctggtccggggtcgaaggggaggggctccaccggctgggttacatcctggaggagatcgacaagaaggatggcgacctcatgtatgccgacgacacagccggctgggacactcgcatcaccgaggacgatctacagaacgaggagctgattaccgagcagatggcccctcaccataagatcctagcgaaggcaatctttaagttaacttaccaaaacaaggtggtaaaggtcctgcggcccaccccgcgcggggccgtgatggacatcatctctcggaaggaccaacggggctccggacaggtaggcacgtacgggctcaacaccttcacaaacatggaggtccagctgatccggcagatggaggccgagggcgtcatcacccaagacgacatgcagaaccccaagggcctgaaggagcgagtggagaaatggctccgggagtgcggcgtcgataggctgaagcggatggccatcagcggcgatgactgcgtcgtaaagccccttgatgagcgcttcgcaacttccctcctattcctgaatgacatggggaaggttcggaaggatatcccccagtgggaaccgtcgaaaggctggaaaaactggcaggaagtgcccttctgctcccaccacttccacaagattttcatgaaggacgggcgcagcctcgtggtaccctgccggaaccaggacgagctcatcggccgcgcccggatctcccagggagccgggtggagcctgcgagagaccgcctgcctcggcaaggcctacgcccagatgtggtcccttatgtacttccaccgccgggacctgcgcctcgctagcatggccatctgcagcgccgtgcccaccgagtggttcccgacgtcccggacgacatggagcatccatgcccaccatcagtggatgaccacggaggacatgctgaaagtgtggaaccgcgtctggatcgaggacaaccccaacatgatagacaagacgccagtacactcctgggaggacattccctacctggggaagagagaggacctttggtgtggcagcctgattgggctttccagtcgcgcgacatgggcgaagaacatccacactgcgatcactcaggtgcggaacctgatcggcaaagaggagtacgtcgactacatgccggtgatgaagcgctactccgcgcccagcgagtccgaaggagtgctgtga

SEQ ID NO: 26270 - RNA, 9867 nt, synthetic construct
  misc_feature 1..9867: note = derived and/or modified CDS sequence (opt11) from DENV-4__FJ850095__SS-prME
  source 1..9867: mol_type = other RNA
agcaccatcaccctgctctgcctgatccccacggttatggcattccacttatccacccgcgacggggaaccgctcatgatcgtcgctaagcacgaaagggggcgtcctctactgttcaagaccaccgagggcataaataagtgcacgctcattgcgatggacctgggggaaatgtgcgaagacaccgtcacctacaagtgtcccctgctggtcaataccgagccggaggatattgactgctggtgcaatttaacgagcacctgggtcatgtacggcacttgtacccagtccggggaacggcggcgggagaaacggagcgtcgccctgactcctcactccggcatggggctagagacccgggccgagacgtggatgagctccgaaggggcctggaagcatgcgcagcgggttgaaagctggatcttacgaaacccgggctttgcgctgctcgccggcttcatggcgtacatgatcggtcagaccgggatccagcgcacggttttctttgtgctcatgatgctggtggccccctcctacgggatgcgatgcgttggcgtggggaaccgcgactttgtggagggtgtctccggaggggcctgggtggacctcgtgctggagcatggcgggtgcgtcacgaccatggcccaggggaagcccaccctggatttcgagctcacgaagaccaccgcgaaagaggtggctctgctgcggacttattgcatagaggccctcatatccaacatcacaactgcgacgcgatgcccgacccagggggaaccctacctcaaggaggaacaggatcaacaatacatctgccggcgtgacgtggtcgacagaggttgggggaacggctgtggcttatttgggaagggcggggttgtgacgtgtgcgaagttcagctgcagcggcaagatcacgggtaacctggtccagatcgagaacctggagtacaccgtggtggtcactgtgcacaacggcgatacccacgccgtcggtaacgacaccagcaatcacggggtgaccgccaccattacgcctcgctccccgtcggtggaggtgaaactgccggactacggggagctcacgctggactgcgagcccaggtccgggatcgatttcaacgaaatgatattaatgaaaatgaagaagaagacatggctcgtacacaagcagtggttcctggacctcccactaccgtggaccaccggcgccgacacgagcgaggtgcattggaactacaaagaacgcatggtcacctttaaggtgccacacgcgaagcgacaagacgtgacagttctagggtcccaggaaggcgctatgcacagcgccctggccggcgccacagaggttgacagcggagacggcaaccacatgttcgcggggcacctcaagtgcaaggtccgcatggagaagctgcgcataaagggcatgtcctacacaatgtgctcaggtaagttctccatcgacaaggagatggcggagacccagcacgggacgaccgtcgtaaaggtgaagtacgaaggtgccggggccccctgcaaggttcccatcgaaatacgggatgtgaataaggagaaggtggtaggccgcgtaataagcgccacgcctctggcggaaaacaccaactctgttacgaacatcgagctcgagccacctttcggcgacagttacatcgtcatcggcgtaggaaactccgccctgaccctgcactggttccggaagggtagctccataggcaagatgttcgaatcgacgtaccgtggggctaaacggatggctattttaggtgaaaccgcctgggacttcgggtccgtgggcggcttattcactagcctggggaaggccgtccaccaggtgttcggctccgtgtacaccactatgttcggtggcgtcagctggatgatccgtatcttaataggtttcctcgtgctgtggatcgggacgaactcgcggaataccagcatggccatgacgtgcatcgccgtgggcgggatcaccttattcctcggttttaccgtccaggcagatatgggatgcgtggtttcctggagcggccgtgaactgaagtgcggctccggcatcttcgtcgtagacaacgtgcacacctggaccgaacagtacaaattccagcccgaaagccccgcgcggttggccagcgccatcctcaacgcccacaaggacggggtctgtggtatccgctccacgactcgccttgagaacgtgatgtggaagcagatcaccaacgagctgaactacgtcctctgggagggcggacacgacctgaccgtcgtcgctggggacgtcaagggtgtgctgacaaagggaaagcgcgcgctcacccctcccgccagcgacctgaagtactcctggaagacctggggcaaagctaaaatcttcacccccgaggcccggaacagcacattcctgatcgacgggcccgatacatccgagtgcccgaacgagcgccgtgcctggaactcgtttgaggtggaggattacggcttcgggatgttcacaacaaacatctggatgaagttcagggaggggtccagcgaggtgtgtgaccaccggctcatgtccgctgcgatcaaggaccagaaggccgtccacgctgacatgggctactggatcgaaagctccaagaaccagacatggcaaatcgaacgtgcgagcctcatcgaggtgaagacctgcctgtggcccaagacacacactctctggtccaacggggtgctggagagccagatgctgatccccaagtcctacgccggtccgttcagccagcacaactaccggcaggggtacgccacacaaacggtgggaccatggcatctcgggaaactggagatagacttcggtgagtgccctggcaccaccgtgaccatccaggaggactgcgaccaccgcgggccctccttgcgcacaaccaccgccagcggcaagttggtgacccaatggtgctgccggagctgcactatgccgcccctgcgcttcctgggagaggacggttgttggtatgggatggagatcagacccctctccgagaaggaggagaacatggttaagtcccaggtgacggccggtcaaggaacctcagagaccttcagcatggggctcctgtgcctaactctattcgtggaggagtgcctgcgcagacgcgtcacccgcaagcacatgatcttagcggtggtcatcaccctatgcgccatcatcctgggcggactcacctggatggacctgcttcgcgccctcatcatgcttggggacacgatgagcggccgaatcgggggccagacccacctggcgatcatggccgtcttcaagatgtcccccggatacgtgctcggcgtcttcctgcgcaagctgacatctcgggagaccgcgctcatggtgatcgggatggccatgacgaccaccctgtcgattccgcacgatctgatggagctcatagacggcatcagcttgggcctgatcctcctgaagatcgtgacccagttcgacaacacgcaggtcgggacactcgcactcagtctgaccttcatccgctccacgatgagcctggtgatggcctggcggacgatcatggccgtactcttcgtcgtcaccctgatccccctgtgccgcacttcgtgcctccagaagcagagccattgggtggagatcacagcgcttatcctgggcgcccaggccctccccgtctacctgatgacgcttatgaagggggcctcccggcggtcatggcccctcaatgagggcatcatggctgtggggttagtttccctgctcggcagcgctctgctgaagaatgatgtaccgctcgccggccccatggtagctggcggcctgctgcttgcggcatacgtgatgagcgggagctccgccgacctctccctggaaaaggctgccaacgtacagtgggacgaaatggccgacatcaccggcagcagtcccatcatcgaggtgaagcaggacgaggacggttccttcagcatccgcgacgtggaggagaccaatatgattaccctcctggtcaagctggccctcattacggtttccggtctctaccccctggccatccctgtcaccatgaccctctggtacatgtggcaggtcaagactcagagatccggcgccctgtgggacgttccgagccccgccgcgacacagaaggcggctttatccgagggcgtgtacagaatcatgcagcgcggcctcttcgggaagacgcaggtcggtgtggggatccacatggaaggcgtgttccacaccatgtggcacgtcacccggggcagcgtgatctgccacgagaccgggcgcctcgagccctcctgggccgacgtgcgcaacgacatgatcagctacggagggggctggcggctgggcgacaagtgggataaggaggaggacgtacaggttctcgccatcgagccgggtaagaaccccaagcacgtgcaaaccaagcccggcctgttcaagaccctgaccggggagatcggggccgtcacactcgacttcaaaccaggcacgtccggtagccccatcatcaaccgcaagggtaaagtgatcgggttgtacggcaacggggtggtgaccaaatccggcgattacgtcagcgcgatcacccaggccgagcggatcggggagccagactacgaggtggacgaggacatttttcgcaaaaagcgtctgaccattatggacctgcacccgggggcgggcaagaccaagcgaatcctgccgtccatcgtccgggaggccctgaagcgcaggctgagaaccctcatcctagcgccaacccgggtggtagccgccgagatggaggaggccctgcgcgggctccccatcaggtaccagacccccgcagttaagagcgagcacacgggccgcgaaattgtggacctgatgtgccatgcgaccttcaccacccggctcttgtcctcgacgcgcgtgccgaactataatctaattgtcatggacgaggcacacttcacggacccaagttcggtggccgcccgggggtatattagcacacgggtcgagatgggcgaggccgcagcgatcttcatgaccgcgacgccacccggggcaaccgacccgttcccccagtccaacagccccatagaggacatcgaaagagagatccccgagcgctcttggaacaccggctttgactggatcaccgactaccagggcaagacggtgtggttcgtgccgagcatcaaagccgggaacgacatagctaactgtctgcgcaagtctggaaagaaggttatccagctctctcgtaagaccttcgacaccgagtaccccaagacgaagctgacggactgggactttgtggtgaccactgacatctccgagatgggggccaatttccgcgccggccgggtaatcgaccccagacggtgcctgaagcccgtgatcctcaccgacgggccggagcgtgtgatcctggcaggccccatccccgtcacgccggcgagcgctgcccagcgccggggccgcatcggtaggaacccggcccaggaggacgatcagtacgttttctcaggcgaccccctgaagaatgacgaggaccacgcccattggaccgaggctaagatgttgttagacaacatctatacccctgaggggatcatccccaccctgttcggaccagagagagagaagacgcaggccatcgacggcgagttcaggctccgtggggagcagcgcaagaccttcgtggagctgatgcggcgcggcgaccttccagtctggctctcttacaaggttgcctcagctggaatcagctacaaggatcgggagtggtgcttcaccggagagcgtaacaatcaaatcctggaggagaacatggaggttgagatttggaccagagaaggggagaagaagaaattacgccccaaatggctcgacgcccgggtctatgcggacccgatggccctgaaggacttcaaagagttcgccagcggccgaaagagtatcaccctggacattctcaccgaaatcgcttccctgcccacctacctgagttcccgcgctaagttggccctggacaacatcgtgatgctgcacaccacagagcggggcgggcgtgcatatcagcacgccctcaacgaactgcccgagagcctggagacgctcatgctggtggccctgctgggcgcaatgaccgccgggatcttcctgttcttcatgcaaggcaaagggataggcaagctgagcatgggcctcattactatcgccgtcgccagtgggctgctgtgggtggccgagatccagcctcagtggattgccgccagcatcatcttggagttcttcctgatggtgctgctcatccccgagcccgagaaacagcggacaccccaggacaatcagctgatctacgtcatactaactatcctcaccatcattggcctgatcgctgctaacgagatgggtctgatcgagaagaccaagaccgatttcggcttttatcaggtaaagacggagacaaccatcctggatgtggacctgcgccccgctagcgcgtggactctgtacgccgtcgctacgaccatcctcaccccgatgctgcggcacaccattgaaaacaccagcgccaacctgtcacttgcggcgatcgccaaccaggccgcggtgcttatggggctcggaaaaggctggcccctccacagaatggacctgggggtgcccttgttggcgatgggctgctactctcaggttaatccaacgaccctgaccgcctctctggtgatgctcctggtgcactacgcaataatcggtccgggtctgcaggcgaaggccaccagagaagcccagaagcggaccgccgccggcattatgaaaaatccaaccgtcgacgggatcaccgtgatagacctcgagcccatcagctacgaccctaaatttgagaagcagttgggccaagtgatgctgctcgtgctgtgtgccggtcagctgctcttgatgcgaacgacctgggccttctgcgaggtgctgaccttggcaaccgggccgatcctgacgttatgggaggggaaccccggccgcttctggaacaccaccatcgccgtgagcacagcaaacatcttccggggctcctacctcgctggggccggactggccttttccctgattaagaacgcccaaacgccccggcgggggaccggtaccactggggaaaccctaggcgagaaatggaagagacagctaaacagcctggaccggaaggagttcgaggaatacaagagatccggcatcctcgaagtagaccggacggaggccaagagcgcattaaaggacggatccaagatcaagcacgccgtgagccgcgggtccagtaagatccggtggatcgttgagcgagggatggtgaagcccaagggcaaggtggtggacctgggatgcggccgtggtggatggtcctactacatggcgaccttgaagaacgtgaccgaggtgaagggctacacgaaagggggccctggacatgaggagcctatccccatggccacgtacggctggaacctagtgaagctgcatagtggcgtcgacgtattttacaagcccaccgaacaggtggacaccctactgtgcgacatcggggagagctccagcaacccgaccatcgaggagggccggacgctgcgcgtcctcaagatggtggagccctggctctccagcaagccggagttttgcatcaaggtgctgaacccctacatgccgaccgtgatcgaggagctggagaagctccagcggaagcacggaggtaacctggtgaggtgccccctgtccagaaattcgacccacgaaatgtactgggtaagtggtgcttccggcaacatcgtatccagcgtgaacactacgtccaagatgctcttaaaccgcttcacgaccaggcaccgcaagcccacctacgagaaagacgtcgacttaggagccgggacgcggagcgtttccaccgagactgaaaagcccgacatgacgatcatcgggcgcaggctccagcgcctacaggaggagcacaaggagacgtggcactacgaccaggagaacccgtatagaacctgggcgtaccacgggtcgtacgaagccccatccaccggcagtgccagcagcatggttaacggggtcgtgaagctgctaaccaaaccctgggacgttatcccaatggttacgcagctggccatgaccgacaccacccccttcggacagcagcgcgtattcaaggagaaggttgacacgcggacaccccagccaaagccgggaacccgcatggttatgacaacgaccgccaactggctgtgggcgctcctcgggaagaagaagaaccccaggctgtgtacccgcgaggagtttatctccaaggtgcggtcaaacgccgcaatcggcgccgtgtttcaagaagaacaaggctggaccagcgcctccgaggcggtcaacgacagccgcttctgggagctcgtggacaaggagcgggccctgcaccaggaaggcaaatgcgagtcatgcgtgtacaacatgatgggaaagcgcgaaaagaagctgggggagttcggcagggccaaggggtcccgggccatctggtatatgtggctcggagcgcgcttccttgagttcgaggcgctggggttcctcaacgaggaccactggtttggccgggagaactcctggagcggtgtcgagggagagggcctgcaccgactggggtacatcctcgaggaaatcgacaagaaggacggcgatctgatgtacgccgacgatacggccggctgggataccaggatcactgaggacgacctgcagaacgaagaactcatcaccgagcaaatggcccctcaccacaagatcttagctaaggcgatctttaagctgacctatcagaacaaggtggtgaaggtccttcgccccacgccgagaggggccgtgatggacattattagccgcaaggaccagcggggcagcggacaggtgggcacctacggcctgaacactttcaccaacatggaagtccagcttatccgccagatggaggctgagggcgtcatcacacaggacgacatgcagaaccccaagggcctcaaggaacgagtggagaagtggctgcgcgagtgcggggtcgatcggctgaagcgcatggctatctccggcgacgactgcgtcgtgaagccgctcgacgagcggttcgggacgagccttctgttcctaaacgacatgggcaaggtcagaaaggacatcccccagtgggagccgagtaaggggtggaagaactggcaggaagtgcccttctgcagccaccacttccacaagatcttcatgaaagacggccgctccctggtggtaccctgccgcaaccaggacgagctgatcggcagggcgcgcatcagccagggggccggatggtcactccgcgagacagcctgcctggggaaggcctacgcccagatgtggagcctgatgtacttccaccggcgcgacctacggctcgcgtccatggccatctgttcagccgtccccaccgagtggttcccgacgagccgcaccacctggagtatacacgcccaccaccaatggatgaccacagaggatatgttgaaggtgtggaaccgggtctggatcgaggacaaccccaacatgatcgacaagacccctgtccacagttgggaggacatcccctatctcggcaaacgcgaagatttgtggtgcggatccctgattggtttgtcgtcacgggccacctgggcgaagaacatccacacagcaataacacaggtgagaaatctgattggcaaggaagaatacgttgattatatgccggttatgaagcggtacagcgccccctctgaaagtgaaggagttctgtga

SEQ ID NO: 26271 - RNA, 9867 nt, synthetic construct
  misc_feature 1..9867: note = derived and/or modified CDS sequence (opt11) from DENV-4__FJ639748__SS-prME
  source 1..9867: mol_type = other RNA
tcaactatgactctactatgcctcattccaaccgcaatggcgtttcacctatcgactcgggatggtgaacctctgatgatcgtggcaaaacacgaacggggcagaccgctgctgttcaaaaccactgaagggataaataaatgcaccctaatcgcaatggatctaggggaaatgtgcgaagataccgttacatataaatgtccactgctagtaaacaccgaaccagaggatatcgactgttggtgcaacctaaccagcacatgggttatgtatgggacgtgcacacaatcgggcgagcggcgccgagaaaaacgcagcgttgcactcacccctcactcagggatgggcttagaaacaagggcggagacgtggatgagctcagagggtgcatggaaacacgcacaaagggttgaaagctggatcctcaggaacccagggttcgcacttctggcgggttttatggcttatatgattgggcaaacaggcattcagcgaacggtattctttgtactaatgatgttggtcgccccctcatacggaatgagatgtgtgggcgtcggcaacagagacttcgtagaaggcgtgagcggcggagcatgggtcgatctagtactagagcacgggggctgcgtcaccacgatggcccaaggcaaaccgacattggactttgaactcacgaagacaactgccaaggaagtagcacttctgcgaacttactgcatagaggccctaataagcaacataaccacagcaacgcggtgtcccacgcaaggagaaccttacctgaaggaagaacaagaccagcagtacatctgccgacgagacgtcgtggaccgaggatggggtaatggatgtggtctcttcggcaaaggcggagtcgtcacatgcgcgaagtttagctgcagtgggaagataactgggaacctggtccagatcgagaatctagaatacaccgtagtcgtgactgttcacaatggagacacacacgcagttgggaatgacacatctaaccacggtgtaaccgcgacaataaccccgaggtcaccctctgtagaagtgcagctcccagattatggggaattaactctggactgcgaaccccggagcggcatagacttcaacgagatgattctcatgaagatgaaaaagaagacctggctggtacacaaacagtggtttttggacctgcccctcccatggactgcgggggccgataccagcgaagtacattggaactacaaggagcgaatggtgaccttcaaagtcccccacgccaaacgacaggacgtcacggtactaggatctcaagagggagctatgcattccgccctggcaggcgcaaccgaagtagactcgggagacgggaaccatatgtttgccgggcatctaaaatgcaaggtccgcatggaaaaattacgaataaaaggcatgagctacaccatgtgcagtggtaagttctccattgataaggagatggccgaaacgcaacacggaactacagtagtcaaggtcaaatatgagggtgcgggcgcgccctgcaaggttccaatagaaatccgggacgtcaacaaggagaaagtagtcgggcgagtaatctccagcaccccattagcagagaacactaattcggtgaccaacatagagttggaacctccattcggagatagctatattgttatcggcgtaggaaattctgctctaactttacactggttcaggaagggatcatccataggaaaaatgttcgaaagcacgtaccgcggcgcaaagagaatggccatactcggcgaaacagcctgggacttcggaagcgtcggtggcctgtttacctcgttggggaaagcggttcatcaagtgttcggatccgtttacaccacgatgtttggcggggtatcgtggatgataaggattctcatagggctcttagtcttatggatcggcacgaacagcaggaacacgagcatggcaatgacttgcatcgcggtaggcggcattaccctgttcctgggattcacagtccaggcggacgtagggtgcgtcgtgagctggagcgggagagagctaaagtgtgggagtgggatcttcgtggtcgataatgtacatacatggacagaacaatataaattccaaccggagtcccccgccagacttgcatccgcgattctaaatgcccacaaagacggcgtatgcggtatacggtcgacgaccaggctagagaatgtgatgtggaagcagatcacaaacgaactaaactacgtgctatgggagggcggacatgacttgacagtggtggccggagacgtgaaaggagtccttacaaaagggaaaagggcgctaacacccccagtaagcgacttgaaatattcgtggaagacctgggggaaagcaaagatattcacccctgaagcccgcaatagcacgttcctaatcgatgggccggacacgagcgaatgccctaacgaacgtagagcatggaacagcctagaggtggaagactatgggttcggcatgtttacaacaaacatctggatgaagtttcgagaggggagctccgaagtctgcgatcaccggctaatgagcgcagcaatcaaggaccaaaaggcagtacacgcggacatgggctactggatcgagtcctcgaagaaccaaacctggcaaattgaaagagcttcattgatcgaagtcaaaacctgtctatggcctaagacccacaccctatggagcaatggagtactagaatcccaaatgctgatcccgaaaagctacgcaggtccattcagccaacacaactaccgccaagggtatgccacacaaacggtaggtccatggcacctgggaaaactggagatagattttggggaatgccccggaacaactgtaaccatacaagaggactgtgaccaccggggccccagccttcgaacgaccacagcatcaggaaagctagtgacacaatggtgctgtcgcagctgcacgatgccgcccctccgattcttaggagaggacggatgctggtacggcatggaaataaggcccctatccgagaaggaggaaaacatggtaaaaagccaagtgaccgcgggccaagggacgtccgaaaccttctcaatgggtctattatgcctcacgctattcgtcgaagaatgcctccgacgacgggtcacacgaaaacatatgatcctagccgtggtgattacactctgcgcgatcatacttggtggcctaacctggatggacctacttcgcgccctaatcatgctcggggacacaatgagcggaagaatcggtggacagacacacctcgccatcatggctgtattcaagatgtcaccagggtacgtcctaggggtattcttgaggaagttgaccagccgagaaacagctttaatggtcatcggaatggccatgacgaccacgctatcaatacctcatgatctaatggagctaatagacgggatatccttagggctcatactgctaaaaatagtaactcagttcgataatacacaggtaggaaccctcgcactgagcctgaccttcatccgcagcaccatgtcgctggtcatggcatggcgaacaataatggctgtactcttcgtggtaacgttgattcccctctgcaggacgagctgcctgcaaaagcaatcacactgggttgaaataacagccctaatcctaggtgcacaagcgcttcccgtatacctcatgactctgatgaaaggtgccagcagaaggtcgtggcctcttaacgagggtatcatggcagtcgggcttgtttccctcctgggaagcgcactattaaagaacgacgtccccctagccggcccgatggtagccgggggactcctactggcggcttacgtgatgagcggaagctcagccgatctaagcctggagaaggctgccaacgtgcaatgggacgaaatggcggacatcactggaagctcgccgataatcgaagtaaaacaggacgaagacgggagtttctcgatacgagacgtcgaagaaacaaacatgattacattgctagtgaaactcgctctcatcacggtatcaggtctctatcccttggcgatacccgtaactatgaccctatggtacatgtggcaagtaaagacgcaacggagtggcgcattatgggacgtaccgagccctgccgcgacacaaaaagccgcgctgtccgaaggagtttaccggataatgcagcgcggtctcttcgggaaaacccaagtcggggtgggcattcatatggagggagtattccacacaatgtggcacgtaacaagaggcagtgtcatctgccatgagacaggccgactcgaaccctcgtgggccgatgtcagaaacgacatgattagctacggaggagggtggaggctaggagacaaatgggacaaagaagaggacgtacaagtcctcgcgatcgagccaggcaagaatccaaaacatgtacaaaccaaaccaggccttttcaaaacactaacaggtgagattggcgccgtcacactagactttaaacccggaacttcgggaagccccataataaatcggaaagggaaggtaatcgggctctacggtaacggggtcgtgacaaaaagcggtgactatgtctccgcaatcacccaagcagagagaattggagagcccgactacgaagtagacgaagacatcttccggaagaaacgcctaaccataatggacctacaccctggggccggaaaaacaaaaagaatcctgccctcgatcgtgcgggaagccctcaaaagaagattacggacactaatactcgcacccacgcgagtagtcgcagcagaaatggaggaggcccttagaggactcccgatccggtaccaaacccccgccgtaaaaagcgaacatactggacgagagatagtagacctaatgtgccacgcgacttttaccacacgtctcttatcctctacccgggtccctaactataatctaatagttatggacgaagcccacttcaccgaccccagcagcgtagccgctagagggtacataagcacacgcgtggaaatgggagaagctgcagcaatctttatgaccgcgacgcccccaggcgcaacggatcccttccctcaatccaactcaccgatagaagacatcgagagggaaataccagaacgctcatggaatacgggcttcgactggattaccgattatcaaggaaaaacagtctggttcgtaccgtccataaaagccgggaatgacatagcgaactgtctacgcaaaagcggtaagaaagtaatccaactatctcgtaaaaccttcgacaccgagtacccaaaaacaaaactcaccgactgggatttcgtggtgacaactgacatttctgaaatgggagctaacttcagagctgggagagtaatcgacccgcggaggtgccttaagcccgtaatcctaactgacggcccagaacgtgtcatactggctggacctatccccgtgaccccagcgagcgcagcacagcgacggggcagaattggccgtaacccagcccaagaagatgatcaatacgtgttcagcggcgacccactaaagaacgacgaagaccacgcacattggacagaagccaaaatgctactggacaacatatacacacccgagggaataataccaacacttttcggcccagagcgcgaaaagacacaagctatagacggggagttcagacttcgcggggagcagagaaaaactttcgttgagctcatgcggcggggcgacctcccagtttggctaagctacaaggtagcaagcgcaggtataagttacaaggacagggagtggtgcttcaccggagagagaaataaccagatacttgaagaaaatatggaggtagaaatctggactagggagggagaaaagaagaaacttcgcccccgatggctggatgcgcgcgtatatgcagacccaatggcactaaaagatttcaaagagttcgccagcggccgaaagtccattacgctcgatatactgacagagatagctagcttgcccacctacctaagtagccgcgccaaactagcactggacaacatcgtcatgttacataccacggaaagaggcgggagagcataccagcacgccttaaacgaactaccggagtccttggaaacccttatgctggtggcactgctcggcgcgatgaccgcaggcatattcctctttttcatgcaaggcaagggcataggcaagctatcgatggggctgataacaatagcagtcgcctcggggctattatgggtagccgaaatccaaccccagtggatcgccgcgagcataatcctggagttcttcctgatggtactgcttatccccgagcctgaaaagcaacgaacaccccaggacaaccagctaatctatgtgatactaacgatactcacgattataggactaattgcggcgaacgaaatgggcttaatcgagaaaactaagaccgactttgggttttatcaagtgaagacagaaacgacgattctagacgtagatttacggcccgctagcgcgtggacattatacgcagttgctaccactatccttactcccatgctgcgccacacgatcgaaaacacaagcgccaaccttagcctagctgctattgcaaaccaagcagccgtcctaatgggactcggcaaaggatggcccctacaccgcatggacttgggagtacccctccttgcaatggggtgctacagccaagtaaacccaacgactctgaccgccagtcttgtcatgctgttggtacactacgcaataattggaccaggactgcaggcgaaggcaactcgagaggcccagaaacgtaccgcagcgggaattatgaaaaatcccaccgtggacggcatcacggtcatcgatttggagccgataagctacgaccccaaattcgaaaagcagctaggccaagtaatgctcctagttctctgcgcaggccaactactcctgatgcgtaccacctgggcattttgcgaggtactaacgctggccaccggcccaatattaacactatgggagggaaaccccggtcggttttggaacacaacgatagcggtaagcacggcaaacatcttccgggggtcatacctcgccggcgcaggactggcgttcagcctaatcaaaaacgcacaaacaccccgtagaggaaccgggaccacgggggagaccctaggtgaaaagtggaaacgacaattgaacagcctagatcggaaggaatttgaagaatacaaacggagtgggattctagaggttgaccgaacagaggcaaagtcggcactgaaagacggaagcaagataaaacacgcagtatcccgcggctcgagcaagatccggtggatcgtggagaggggaatggtgaaacccaagggcaaagttgtggacctggggtgcggacggggaggctggtcatattatatggcgaccctgaaaaacgtcaccgaggtcaaaggatacactaaaggcggtcctggacacgaagaacccatcccaatggccacgtatggctggaacctggtaaagttacactccggagtggatgtattctacaaaccaacggaacaggtcgacacactcctgtgtgatatcggagaatcctcaagcaatcccacaatagaggaaggaagaacgctccgggtgctcaaaatggtagagccgtggctaagcagcaagccggagttctgcataaaggtactaaacccatacatgccaacagtaattgaagaactcgagaaattacaaagaaagcacgggggaaacttagtgcggtgtcccctaagccgcaacagcacacatgagatgtactgggtcagcggtgccagcggaaacatagtttcatcagtgaacaccacaagtaagatgctactcaacaggttcacaacgagacatcgtaaaccaacatacgaaaaagatgtcgacctaggcgccggcacacggagtgtgagtacggaaaccgagaagcccgatatgacaataatcggccggcgcctacagcgactccaggaggaacacaaagaaacgtggcactacgatcaagaaaatccttaccggacctgggcataccatggcagctacgaagcccccagcacaggcagcgccagctcgatggtcaacggcgtcgtgaagctcctgacaaagccgtgggacgttatcccgatggtaacacagctggcaatgacagataccaccccattcggacaacaaagagtattcaaggaaaaagtagacacgaggacaccacagtccaaaccgggcacgcggatggtaatgacaacaacagctaactggctatgggcactactcggcaagaagaagaatccccgattatgtacacgagaagagttcatcagcaaagtaaggagtaacgccgcaataggcgcggtctttcaggaagaacaaggctggacgtcagcgtcggaggccgtcaacgactcgcgcttttgggaactggtcgacaaggagcgagccctacaccaagagggcaaatgcgaatcatgcgtgtacaacatgatgggcaaacgtgagaagaaactaggtgagttcggacgcgcgaaagggtcacgagccatatggtacatgtggctaggtgccagattcctcgaatttgaagcactgggctttctcaatgaggaccactggttcgggcgggagaactcgtggagtggggtcgagggcgagggtctacaccgcttaggctacattctagaggaaattgacaagaaagacggagacctcatgtatgccgacgacacggcaggctgggacacgagaatcactgaggacgacctacaaaacgaagaactcataacagaacaaatggcgccgcaccataaaatcctggcaaaagcaatttttaaactcacgtaccagaataaggtcgtgaaagtcctcagaccgacacccaggggagcggtgatggacatcatatcccggaaggaccaacggggctcagggcaggtagggacatacggcctgaatacatttacaaacatggaggtgcagctcataagacagatggaagcagaaggggtcataacacaagacgacatgcaaaacccaaaaggcctgaaggaacgagtcgaaaagtggctacgcgaatgtggcgtagacagactaaaacgaatggccataagcggagacgactgcgtagttaagccgttagacgaacgattcgcaacgtctttgctgtttttgaacgacatgggcaaagtacgaaaagatataccccaatgggaaccctccaagggctggaagaactggcaggaggtgcctttttgcagtcaccacttccacaaaatatttatgaaggacgggagaagcctagtggtcccatgcagaaaccaagacgaactcatcggcagggcacgtatcagtcaaggcgccggatggtcactacgagaaacggcgtgcctcggaaaagcgtacgctcagatgtggagcttgatgtactttcaccggcgagacttacgactagcaagtatggcaatatgctcagctgtaccaaccgaatggtttccgactagccgaaccacatggtccatacatgcacatcaccagtggatgactacagaggacatgctaaaggtttggaacagagtatggatagaggataatcccaacatgatagacaaaaccccagtgcactcatgggaggacataccatacttagggaagcgtgaggacctgtggtgcggaagtctgataggattaagcagcagagcaacatgggccaaaaatatccatacagccataacgcaagtccgaaacttaatcggaaaggaggagtacgtagactatatgccagtgatgaagcgctatagcgcgcctagcgagaatgaaggagtactttaa

SEQ ID NO: 26272 - RNA, 9867 nt, synthetic construct
  misc_feature 1..9867: note = derived and/or modified CDS sequence (opt11) from DENV-4__FJ639764__SS-prME
  source 1..9867: mol_type = other RNA
agcaccattacgctgctctgcctgatcccgaccgtgatggcatttcacctatccacccgcgacggcgagccccttatgattgtcgcgaagcacgagcgggggcgccccctgctgttcaagaccaccgagggcacgaacaagtgcaccctcatcgcgatggacctgggtgagatgtgcgaggataccgtgacctacaaatgccccctgctcgtgaacacggagcctgaagacatcgactgctggtgcaatctgaccagcacctgggtgatgtacggtacctgtacgcagtccggagagcggcgccgggagaagcgcagcgtggccctgaccccgcactccggcatgggcctcgaaacccgggccgagacctggatgagttccgagggggcctggaagcacgcccagcgcgtggagagctggatcctgcggaaccccgggttcgcactgctcgccgggttcatggcctacatgatcggccaaacggggatccagcgcaccgtgttcttcgtgctgatgatgctggttgccccctcctatggcatgcggtgcgtcggcgtggggaaccgcgacttcgtggagggcgtgagcggaggcgcgtgggtggacctcgtgctggagcacggcgggtgcgtcaccaccatggcccagggcaagcccaccttggacttcgaacttaccaagaccaccgccaaggaggtggccctgctgagaacatactgcattgaagccctcatatccaacattaccacagcgacgcgctgcccgacgcagggggagccatacctaaaggaggagcaggaccagcagtacatctgccggcgtgacgtggtggaccggggctgggggaacggttgcgggctgttcgggaagggtggggtggtgacctgcgcgaagttcagctgctccggcaagatcaccggcaatctcgtccagatcgagaacctggagtacaccgtggtggtcacggtacacaacggcgacacccacgcagtcggcaacgacactagcaaccacggggtgaccgcgactatcacgccccggtccccaagcgtggaggtcaagctgccggactacggcgagctcactctggactgcgagccccggtccggtatcgacttcaacgagatgatcctgatgaagatgaagaagaagacctggttagtgcataagcaatggttcctggacctgcccctcccctggacggccggcgcggacaccagcgaggtgcactggaactacaaggagcgcatggtcacgttcaaggtgccgcacgccaagcggcaggacgtgaccgtcctggggtcacaggagggcgcgatgcacagcgcccttgccggcgcgactgaggtggacagcggggacggcaaccatatgttcgccggccaccttaagtgcaaggtgcgcatggaaaagctgcgcatcaagggcatgtcctacacgatgtgcagcggtaagttctcaatcgataaggagatggcggaaacccagcacgggaccaccgtcgtgaaggtcaaatacgagggcgccggggccccatgtaaggtccccatcgagatccgtgacgtgaacaaggaaaaggtggttgggcgcgttattagctccacgcccctggcggagaacaccaacagcgtcacaaacatcgagctcgagccgccgttcggggactcctacatcgtcatcggcgtgggaaacagcgccctgaccctgcactggtttcggaaggggtccagcatcggcaagatgttcgaatccacgtaccgaggggccaagcggatggcgatcctcggcgagacagcgtgggacttcgggagcgtgggtgggcttttcaccagcctggggaaggccgtccatcaggttttcggaagcgtgtacaccacgatgttcgggggcgtctcctggatgatccgcatcttgatcggcttcctggtgctctggataggcaccaacagccggaatacctccatggccatgacctgcatcgccgtgggcgggataacgctgtttctcggattcacagtccaagccgacatggggtgcgtggtgagctggagcggtcgcgagttgaagtgtgggagcggaatcttcgtcgtggacaacgtgcacacctggattgagcagtacaagtttcagcccgagagccccgcgcggctggcctccgccatcctcaacgcgcacaaggacggtgtctgcgggatccgcagcaccacgcggctggagaacgtgatgtggaagcagatcaccaacgagctgaattacgtgttgtgggagggcggacatgacctgaccgtcgttgccggggacgtgaagggcgtcctgaccaaggggaagcgcacgctcaccccgcccgtgtccgatctgaagtacagctggaagacctggggcaaggcgaagattttcacccccgaggcccggaactccaccttcctgatcgacgggcccgacaccagcgagtgccccaacgagcgaagggcctggaactccctcgaagtagaagactacggattcgggatgttcaccaccaatatctggatgaagttccgcgagggcagctcggaggtctgcgaccatcggctgatgtcagctgccatcaaggaccagaaggcggtgcacgccgacatgggctactggatcgagtcctcgaagaaccagacgtggcagatcgaacgagcctccctgattgaggttaagacctgcctctggcctaagacccacaccctgtggagcaacggggtcctggagtcccagatgctcataccaaagagctatgcgggcccgttcagccagcacaattaccgccaggggtacgctacccaaacggtgggcccctggcacctggggaagctggagatcgacttcggcgaatgccccggcaccaccgtgaccatacaagaggactgtgatcaccgcgggcccagcctccgcactaccaccgccagcggcaagctggtcacccagtggtgctgccggtcctgcacgatgccgcccctgcgcttcctcggggaggacggctgctggtatggaatggagatacggcctctaagcgagaaagaggagaacatggtgaagtcccaggtcaccgccggccagggcacctcagagaccttctccatggggctgctctgcctgactctgttcgtggaggagtgcctgcgccggcgcgtgacccggaagcatatgatcctggcagtcgtgatcaccctgtgcgctatcattctcggcgggctgacctggatggacctgcttagggcgcttataatgctgggcgacacgatgagtggccggatcgggggccagacccacctcgccatcatggccgtgttcaagatgtcccccgggtacgtcctcggtgtgttcctgcgccggctcaccagcagggagaccgccctgatggtgatcggcatggccatgacgaccaccctgtccatcccgcacgacctcatggagctgatcgacggcataagcctgggtctcatcctgttgaagatcgttacccagtttgacaacactcaggtggggaccctcgcgctgtcccttaccttcatccggagcaccatgtccctcgtgatggcctggcgcacgatcatggccgtcctgttcgtggtgaccctgatccccctctgccggacctcgtgcctgcagaagcagtcccattgggtcgaaatcaccgccctgatcttaggcgcccaggcgctgcccgtgtacctgatgacgctcatgaagggggccagccgccggtcctggcctcttaacgagggcatcatggccgttggactggtctcgctgttgggctccgccctgctcaagaacgacgtgccgctggcgggccccatggtggccgggggtctgctcctggccgcttacgtcatgagcgggagctccgcggaccttagcctcgagaaggcggccaacgtgcagtgggacgagatggccgacattaccggctcgagtcccatcatcgaggtgaagcaggacgaggacgggtccttcagcatccgagacgtcgaggagaccaacatgatcaccctgcttgtgaagctcgccctgatcacggtgtcgggcctgtaccccctggccatcccggtcaccatgaccctgtggtacatgtggcaggtcaagacccaacgtagcggcgcgctgtgggacgtgccctccccggccgccacccagaaggccgctctatcggagggcgtctaccgcataatgcagcggggcctgttcggcaagacccaggtgggcgtgggcatccacatggagggcgtcttccacaccatgtggcacgtgacccgcggctccgtaatctgccacgagaccgggcggctggagcccagctgggcggacgtccggaacgacatgatctcctacggcggcggttggcggctaggcgacaagtgggataaagaggaggacgtccaggtgctggccgtcgagccggggaagaaccccaagcacgtgcagacgaaacccggcctgttcaaaaccatcaccggggagatcggcgccgtgaccctcgacttcaagcccgggacgagcggctcccccattatcaataggaagggtaaggtcattgggctgtacggcaacggggtggtcactaagagcggcgactacgtctcagccattacccaagctgagaggatcggcgagcccgactacgaggtggatgaagacatcttccggaagaagcgcctgaccatcatggacctccaccccggcgcgggcaagacgaagcggatcctgccgtctatcgtgcgcgaggccctaaagcggcgcctgcggaccttaatcttagcccccacccgcgtcgtggccgcggagatggaggaggccctgcgcgggctccccatccgctaccagacccccgcagttaagtccgagcatacgggccgggagattgtcgacctgatgtgccacgccaccttcaccacccgtctgctcagcagcacgcgggtgccaaactataacctgatcgtcatggacgaagcccacttcactgacccctccagcgtcgctgcccgcgggtacatctccacccgggtggagatgggcgaggccgccgccatcttcatgaccgctacgccccccggggcaaccgacccgttcccccagagcaattcccccattgaggacatcgagcgcgagatccccgagaggagctggaacaccggattcgattggatcaccgactaccagggaaagacggtctggttcgtgccgtccatcaaggccggcaacgacatcgccaactgcctgcgcaagagcggcaaaaaggtgatccaactctcccgcaagacctttgacaccgagtaccccaagaccaagctgacggactgggacttcgtcgttaccaccgacatcagcgagatgggggccaacttccgggctggccgtgttatagacccccggagatgcctgaagcccgtcatcctgaccgatggtccggagcgggtcatcctcgcgggccccatccctgtgacgcccgcctccgccgcgcagcgcagaggccgcattggacgtaaccctgcccaagaggacgaccagtacgtgttcagcggggaccccctgaagaacgacgaggaccatgcccactggaccgaggccaagatgctcctggacaacatctacacccccgaagggatcatccccaccctgttcggccccgagcgcgaaaagacgcaggcaatcgacggcgagttccgactgcgcggggagcagcgtaagaccttcgtggaactgatgcgccggggcgatctgcccgtgtggctctcctacaaggttgcgagcgctggtatttcttacaaggatcgcgagtggtgctttaccggcgagcggaacaaccagattctggaggagaacatggaggtggagatatggacccgggagggtgagaagaagaagctacggccccgctggctagacgcccgcgtgtacgcagacccgatggccctgaaggacttcaaggagttcgcgagcggccgtaaatccataacccttgacatcctcacggagatcgccagcttgccgacctatctgtccagtcgcgccaagttagccctggacaacatcgtcatgctacacaccaccgagcggggcgggcgcgcctaccagcacgcgttaaatgagctgcccgagagcctggagacgttgatgcttgtggccctactcggcgccatgaccgccgggatctttctgttcttcatgcagggcaaggggatcgggaaactgtccatgggcctaatcaccatcgcagtggcgagcgggttgctgtgggtcgccgagatccagccccagtggatcgccgcctccatcatcctcgaatttttcctgatggtgctgcttatcccggagcccgaaaagcagcggactccgcaggacaaccagctgatctacgtgatcctgacgatcctcacaatcatcggcctgatcgcggccaacgaaatggggcttatcgagaagaccaagaccgacttcggcttttaccaggtcaagacagagaccaccatcctcgacgtcgacctacgccccgccagcgcttggaccctatatgccgtggcgaccaccatcctcaccccgatgctgcggcacaccattgagaatacgtccgcaaacctgagcttggccgccatcgccaaccaggcggccgtgctgatgggactgggcaagggctggcccctccaccgcatggacctgggggtaccccttttagcgatggggtgctactcgcaggtaaaccccaccaccctgaccgcctcgctggtcatgttactggtgcactacgccatcatcgggcctggcctgcaagcgaaggccacgcgggaggcccaaaaacgtaccgccgcgggcatcatgaagaacccgaccgttgacgggatcaccgtcatagatttggaacccatctcctatgacccaaaatttgagaagcagctaggccaggtgatgctgctagtgctgtgcgccgggcagctgctcctgatgcggactacctgggccttctgcgaggtactgacgctcgccaccggcccgatcctaacgctgtgggagggcaaccccggtcgcttctggaacaccaccatcgccgtgagcaccgctaacatcttccgtgggtcctacctcgccggagccggcttggccttctctctgatcaagaacgcacagaccccccgccggggcaccgggaccactggggaaaccttgggcgaaaagtggaagcgccagctgaactctctggaccggaaggaattcgaggagtacaagcgcagcggaatcctcgaggtggaccggacggaggctaaatccgccctgaaagacgggagcaagatcaagcacgccgtatcccgcggcagctccaagatccgctggattgtggagcgggggatggtgaagcccaagggcaaggtcgtggacctggggtgcggccggggcgggtggagctactatatggccaccctcaagaacgtgaccgaggtcaagggctacaccaagggcgggccggggcatgaggagcccatccccatggccacgtacggctggaacctggtgaagctgcactcaggcgtggatgtcttctacaagccgaccgagcaggtggacactctcctgtgcgacatcggggagtccagctccaaccctaccatcgaggagggccggacactgcgcgtgctcaagatggtcgagccctggctgagctccaaacccgaattttgcatcaaggtgctcaacccctacatgccgaccgtcatcgaggaactggagaaactacagcggaagcacggaggcaatctggtgcgctgcccgctgagcagaaattccacccacgagatgtactgggtgagcggagcgtcagggaacatcgtctcgtccgtgaacaccactagcaagatgctactgaaccgcttcaccacccggcaccgcaagccaacgtacgagaaggacgtggacctgggcgccgggacgcggtccgtcagcaccgagaccgaaaaacccgacatgaccatcatcgggagacggctccagcgcctgcaggaggagcacaaggagacgtggcattacgaccaggagaacccgtaccggacctgggcctaccacgggtcctacgaggcccccagcactggctccgcaagctccatggtcaacggcgtggtgaagctactcaccaagccctgggacgtgatccccatggtgacgcagctggccatgaccgacactacccccttcggtcagcagcgcgtcttcaaggagaaggtggacacgcggacgccccagcccaagccgggcacccggatggtgatgaccacgaccgctaattggctgtgggccctcctggggaagaagaagaacccccggctgtgcacgcgcgaggagttcatcagcaaggtacggagcaacgccgcgatcggcgccgttttccaggaggagcagggatggacctccgccagcgaggccgtgaacgactcccgcttctgggagctcgtcgacaaggaacgcgccctgcaccaggagggcaagtgcgagagctgtgtgtacaacatgatgggcaagcgggagaagaagctgggggagttcggccgcgcaaagggatcccgggccatctggtacatgtggctcggcgcccgcttcctggagttcgaggccctggggtttctcaacgaggaccactggttcggccgagagaacagttggtccggcgtggagggtgagggcctgcaccgcctggggtacatcctcgaggaaatcgacaagaaggacggcgacctgatgtatgccgacgacacggcgggctgggacacacggataacagaggacgacctgcagaacgaggagctcatcaccgagcagatggcgccccaccacaagatcctggccaaggccatcttcaagctgacctaccagaacaaggtcgtcaaggtgctccgccccacgccgcgcggggccgtaatggacatcatcagccgcaaggaccagcggggtagtggccaggtaggcacctacggactgaacaccttcacaaacatggaggtgcagctgatcaggcagatggaggccgagggtgtcatcactcaggacgacatgcagaaccccaagggcctcaaagagcgggttgaaaagtggctgagggagtgcggggtggaccggttaaagcgcatggccatcagcggcgacgactgcgtcgtgaagccgctcgatgaacggtttgggacctccctgctgtttctcaacgacatgggcaaggtgcgcaaagacatcccacaatgggagccgagcaaggggtggaagaattggcaggaagtcccgttctgctcacaccatttccacaagatcttcatgaaggacggacggtctctggtggtgccgtgccgcaaccaggacgaactgatcggccgcgcccgaatctcccagggagccggctggagcctccgcgaaacggcatgcctggggaaggcctacgcccagatgtggtccctgatgtacttccatcggcgcgacctccggctggccagcatggccatctgtagtgcggtccccactgagtggttcccaacgtcccgcaccacttggagcatccacgcccaccaccagtggatgaccacggaggatatgctgaaggtgtggaaccgggtgtggatcgaggacaaccccaacatgatcgacaagaccccggtccactcgtgggaggacattccctacttgggcaagcgggaggatctgtggtgcgggagcctgatcggcctctcgagtagggcaacctgggccaagaatatccataccgccatcacccaggtgcgcaacctgatcggcaaagaggaatacgtggactacatgccggtcatgaagcgctactcagcgcccagcgagtctgagggggtgctgtga

SEQ ID NO: 26273 - RNA, 9867 nt, synthetic construct
  misc_feature 1..9867: note = derived and/or modified CDS sequence (opt11) from DENV-4__FJ639773__SS-prME
  source 1..9867: mol_type = other RNA
agcaccatcaccctgctctgcttgatccccacggtgatggccttccacctgtccacaagagacggcgagcctctcatgatcgtcgcaaagcacgagcgggggcgccccctgctgttcaaaaccaccgagggcatcaacaagtgcacgctaatcgcgatggacctgggggagatgtgcgaagacactgtgacctacaagtgccccctgctcgtgaacaccgagcccgaggatatagactgttggtgcaacctgacgtcgacctgggtcatgtacggcacctgcacgcagagcggtgagcggcgccgggagaagcgcagcgtagccctgacgccgcactccggaatgggcctcgagacccgggcggagacctggatgtcgtccgagggggcctggaagcacgcccagcgcgtggaaagctggatcttgcggaaccccggcttcgcgctgctcgccggtttcatggcctatatgatcggccagactggaatccagaggaccgtcttcttcgtgctaatgatgctcgtggccccctcctatggcatgagatgcgtcggcgtggggaaccgagacttcgtggagggcgtcagcgggggcgcgtgggtggatctcgtgctggagcacggagggtgcgtcaccaccatggcccagggcaagcccaccctggacttcgagctcacgaagaccacggccaaggaggtggccctgctccggacctactgcattgaggccctaatctccaacatcacgaccgcgacccggtgccccacccagggggagccctacctgaaggaggagcaggaccagcagtacatctgccggagagacgtggtggaccggggctgggggaacggatgcggcttattcggaaagggtggggtggttacctgcgccaagtttagctgctccggcaagatcaccgggaacttggtacagatcgagaaccttgagtacacagtggtggtcaccgtgcacaatggcgacactcacgccgtcggtaacgacacctccaaccacggagtgaccgccactatcactccccgatcccccagcgtggaggtcaagctaccggactacggggagctcaccctagattgcgagccgcggtccggaatcgacttcaacgagatgatcctgatgaagatgaagaaaaagacctggctcgtccacaagcaatggttcttagacctgcccttgccctggacaaccggggccgacacgagcgaggtgcactggaattacaaggagcgaatggtcaccttcaaagtgccgcacgcgaagcggcaggacgtgaccgtcctggggtcccaggagggcgctatgcacagcgccctcgctggcgccactgaagtcgactcgggggacggcaaccacatgtttgcggggcacttgaagtgcaaagtaaggatggagagactgcgaataaagggcatgtcctacacaatgtgcagcggcaagttctcaatcgacaaagaaatggccgagacccagcatgggacgacagtcgtgaaagtgaagtacgaaggcgcgggggccccgtgcaaggtacccatcgaaatccgagacgtgaacaaggagaaggtggtcggcagagtgatctctgccacgcccctggccgagaacaccaacagtgtgaccaacatcgagcttgaaccccctttcggggacagctatatcgtcatcggcgtgggcaactccgcgctgaccctgcactggttccgcaagggaagctcaatcggcaagatgtttgagagcacgtaccgcggggccaaacgcatggccatcctcggcgagaccgcgtgggactttggatcagtgggcggcctattcaccagcctggggaaggccgtccatcaggtcttcggctccgtgtataccacgatgtttgggggggtcagctggatgatccggatcctcatcgggttccttgtgctgtggataggtaccaactcccgcaacaccagcatggccatgacctgcatcgccgtgggcgggatcacgctgttcctcggcttcacggtgcaggccgacatgggttgcgtggtgagctggagcggacgggagctgaagtgcggaagtggcatcttcgtagtagacaacgtgcacacctggaccgaacagtacaagttccagcccgagagccccgcccgcctggcctccgccatcctaaacgcgcacaaggatggtgtctgcgggatccggagcacgacacgccttgagaacgtgatgtggaagcagatcaccaatgagctgaactacgtgttgtgggagggcgggcatgacttgacggtggtggcaggcgacgtgaagggcgtcctgactaaggggaagcgggcgttaaccccgccggcctctgacctgaaatactcctggaagacctggggcaaggccaaaatcttcacccccgaggcccgcaacagcacattcctgatcgatgggcccgacacgtccgagtgcccgaacgagcggcgcgcctggaacagcttcgaggtcgaggactacggcttcgggatgtttaccaccaacatctggatgaaattccgggagggcagtagcgaagtgtgcgaccaccgcctcatgtcggcggccatcaaggatcagaaggccgtccacgccgatatgggatactggatcgagagctccaaaaaccagacgtggcagatagagcgggcgagcctgatcgaggtgaagacctgcctgtggcccaagacccacaccctctggtccaacggggtgctagagagccagatgttgatccctaagtcctacgccggcccgtttagccagcacaactaccgccaggggtacgctacccaaacggtcggcccctggcatttgggtaagctggagatcgacttcggcgagtgccccggcaccaccgtaaccatccaggaggactgcgaccaccgagggccgtccctgcggacgacaactgcctcgggcaagctcgtgacccagtggtgctgtaggagttgcacgatgccgcccctgcggttcctgggggaggacggctgttggtacgggatggaaatccgccccctctccgaaaaggaggagaacatggtcaagagccaggttaccgccggccagggcacctccgaaacctttagcatggggctgctttgcctcacgttattcgtcgaggagtgcctgagaagaagggtgacccgcaagcacatgatcctcgctgtggtgatcaccctgtgcgccatcatcctgggcgggttgacctggatggatctcctgcgggccctcatcatgctgggagacacgatgtccggtcgcattgggggccagacccacctggccatcatggccgtgtttaagatgagccccgggtacgtgctcggcgtcttcctgcgaaagctaacttcccgcgagaccgcgctcatggtaatcgggatggccatgacgaccaccctgagcatcccgcacgacctcatggagctcatcgatggcatatccctgggcctaatcctactgaagatcgtgacccaattcgataacacgcaggtcgggaccctggccctcagcctgaccttcatacggtccaccatgagcctggtgatggcatggcgtacgatcatggccgtcctcttcgtcgtgaccctgatccccctgtgccggacctcctgtctccagaagcagagccactgggtggagatcacggcgctgattctgggtgcccaggccctcccagtctacctgatgacgctgatgaagggggcgtctcgccggagctggcccctcaacgagggcatcatggcggtggggctggtgtccctgctgggaagcgccctgctgaaaaatgacgtcccgctcgccgggccaatggtggccgggggccttctgttggccgcgtatgttatgtccgggagctctgccgacctgtccctggagaaagccgccaacgtgcagtgggacgagatggccgacatcaccggtagtagtcccattatcgaggtgaagcaggacgaggatgggagtttttccatacgcgacgtagaggagaccaatatgatcaccctcctggtcaagctggcgctcatcacggtgagtggcctgtaccccctggctataccggtgaccatgaccctctggtacatgtggcaagtcaagacgcagcggtcaggcgccctttgggacgtgccttccccagccacaacgcagaaggccgcgctgtcagagggggtgtaccgcatcatgcagcggggcctgttcgggaagacacaggtgggggtggggatccatatggaaggcgtgttccacaccatgtggcacgtcacccgaggcagcgtgatctgccacgagacggggaggctggagccctcctgggccgatgtacggaatgacatgatcagttacggcgggggttggcgcctgggcgacaagtgggacaaggaagaagacgtccaggtgctcgcaatcgaaccggggaagaaccccaaacacgtacagaccaagcccggcttattcaaaaccctgaccggggagatcggcgccgtcacgctcgacttcaagcccgggacctctggcagcccaataattaaccggaagggcaaggttatcgggctctacggcaacggggttgtaaccaagtccggcgactacgtgtccgcgattacccaggcggagagaattggggagcccgattacgaggtggacgaggacatcttccggaagaagcgcctgacgatcatggacctccaccccggcgctggcaaaaccaagcggatcctgccgtccatcgtcagggaagccttgaagcggcgcctgcggactctcatcctcgcccccacccgcgtggtcgctgccgagatggaggaggccctgcgggggctccccataagataccagacccccgccgtcaaaagcgagcacacgggccgtgagatcgtagacctgatgtgccacgctaccttcaccacgaggctgctctccagcacccgggtgccgaactacaacctaatcgtcatggacgaggcgcatttcaccgaccccagctcagtggccgcccgcgggtacatctccacccgggtcgagatgggcgaagccgccgcgatcttcatgacggccaccccccccggggctaccgacccgttcccccagtccaactctcccattgaagacatcgaacgcgagatccccgagcgctcatggaataccggcttcgactggataaccgattaccagggcaagaccgtgtggttcgtaccgtcgatcaaggccgggaacgacatcgccaattgcctgcgtaaatccggtaagaaggtcatccagctctcacgcaaaacctttgacactgagtaccccaagacgaagttgaccgactgggacttcgtggtaaccaccgacatttccgagatgggggcgaacttccgggcgggccgcgtcatcgatccccgacgttgcctgaaacccgtgatccttacggacggcccggaacgggtgatcctggccggccccattcctgtgacccccgccagcgccgcccagagacgggggagaattgggcggaacccagcccaggaagacgaccagtacgtgttctccggcgaccccctgaagaacgacgaggatcatgcccattggaccgaggccaagatgcttctggacaacatctacacccccgaggggatcatccccacgttgttcggcccagaacgcgagaagacccaagcgatcgacggcgagttccggcttcgcggggagcagcggaagaccttcgtggagctgatgcgccggggggacctgcccgtctggctcagctacaaggtcgctagtgccgggataagctacaaggatcgcgagtggtgcttcaccggcgaacggaacaaccagatcctggaggagaacatggaggtggagatctggacgcgcgagggcgagaagaagaagctgcggcctaagtggctcgacgcccgcgtctacgccgaccccatggcgctaaaagacttcaaagagttcgcatccggcaggaaaagcattacgttggacatcctaaccgagatcgcctccctgccgacctacctgagctcccgggccaagctcgccctggacaacatcgtgatgctgcacaccacggagcgcggagggcgggcgtatcagcacgccctgaacgagctgcctgagagcttggagacattaatgctggttgccctgctcggagccatgaccgcgggcatattcctgttcttcatgcaaggcaaggggatcggcaagctgagcatgggactcatcaccatcgcggtcgcaagtgggctgctgtgggtggccgagatccagccccagtggatcgccgcgagcatcatcctcgaattcttcctgatggtgctgctcattccggagcccgagaagcagcgcacgccccaggacaaccagttgatctacgtaattctgaccatcctcaccattatcggcctgatcgccgccaacgagatgggtctgatcgaaaagacaaagaccgacttcggcttctaccaggagaaaaccgagacgaccatcctcgacgtggacctgcggcctgcctccgcctggacgctgtacgccgtggccaccaccatcctcaccccgatgctgcgacacacgatcgaaaacaccagcgccaacttgagtctcgccgctatcgcgaaccaggcagccgtcctgatgggactgggtaaaggctggcccctccaccggatggacctcggtgtgccgctgctagccatgggctgctactcgcaagtgaaccccacgactctgactgcgtctctcgtcatgctcctggtccactacgcgatcattgggccggggctgcaggcaaaagccacccgcgaggcccagaagcggaccgcggccggaatcatgaagaaccccaccgtagacggtatcacggtcatcgatcttgagcccatcagctatgaccccaagttcgagaagcaactgggccaggttatgctgcttgtgctgtgcgccgggcagctgctcctgatgcgcaccacttgggccttctgtgaggtcctgaccctcgcaaccggcccgatcttaaccctgtgggaggggaaccccggccggttttggaataccaccatcgcggtttccacggccaatatattcaggggcagctacctcgccggggccggcctggccttctccctgatcaagaacgcgcagacaccccggcgcgggaccggcaccaccggggagacgttgggcgagaagtggaagcgtcagctcaacagcctggaccgcaaggagttcgaagagtataagcggtccggaatcctcgaggtggatcgcaccgaagccaagagcgcattgaaggacgggtccaagatcaagcatgccgtcagccggggctccagcaaaatccgctggatcgtggagcgcgggatggtgaagcctaagggaaaggtcgtcgacctggggtgcggtcggggcgggtggtcctactacatggccaccctcaagaatgtgaccgaggtcaaaggctacaccaagggtggtccggggcacgaggaacccatacccatggcgacctacggctggaacctggtgaagctgcacagcggagtcgatgtgttctacaagcccaccgagcaggtggacaccctcctatgcgacataggggagagctccagcaacccaacgatagaggagggccgcaccttgcgggttttaaagatggtcgaaccgtggctcagcagcaagcccgagttctgcattaaggtgttgaacccctacatgccgaccgttatcgaggagttagagaagctccagaggaagcacggtggcaacctggtccgctgccccctgtcccgcaattcaacccacgagatgtactgggtgtccggggccagtgggaacatcgtaagcagtgtaaataccacctccaagatgctcctaaacagatttaccactcgccaccggaagcccacgtacgagaaggacgtggacctgggcgccgggacgcgcagcgtctccacagagaccgagaagcccgacatgacgatcatcggccgacgcttacagcgcctacaggaggagcataaggagacttggcactacgaccaggaaaacccgtaccgaacctgggcctaccatgggtcctacgaggcgccctccaccggcagcgcctcctccatggtcaacggcgtggtcaagctgctcacgaaaccctgggacgtgatcccgatggtaacccagctggccatgaccgacaccacgccattcgggcagcaacgagtgttcaaggagaaggtagacacccgcaccccccagcctaagccgggcacccggatggtcatgaccaccaccgccaactggctgtgggcccttctggggaagaagaaaaacccccgcctgtgtacccgggaggagttcatttccaaggtccgcagcaatgcggccatcggcgccgtgttccaagaggagcaagggtggacgagcgcctccgaagcagtcaacgacagccggttttgggagctcgtcgacaaggagcgcgctttgcaccaggagggcaagtgcgagtcatgcgtgtacaacatgatggggaagagggagaagaaactgggagagttcggccgggccaagggttcacgcgccatttggtacatgtggctcggcgcccggtttctggagtttgaggccctggggttcttaaacgaggaccactggttcggtagggagaactcctggagcggcgtggagggggagggccttcatcggttagggtacatactcgaggagatagacaaaaaggacggcgacctcatgtacgcggatgacactgccggctgggatactcgcatcaccgaagatgatctgcagaacgaggagctcatcaccgaacagatggctccccatcacaagatccttgctaaggcgatcttcaagctgacgtatcagaacaaggtcgtgaaggtcctccggcccaccccgcgcggggccgtcatggacatcatctcccggaaggaccagcgaggcagcgggcaagtgggcacctacggcttgaacaccttcacgaacatggaggtgcaactgatccggcagatggaggccgagggcgtcatcacgcaggacgacatgcaaaaccccaaaggcctaaaggagcgcgtggagaagtggctgcgggaatgcggtgtcgatagactgaagcggatggccataagcggagacgactgtgtcgtcaaacccctggatgagcgcttcggtacgagcctgctgttcctcaacgatatgggcaaagtacggaaggacatcccccaatgggagccgagtaaggggtggaagaactggcaagaagtccccttctgctcacaccacttccacaagatcttcatgaaggacggccgcagtctggtggtgccctgccggaaccaagacgagctgataggccgcgcccgcatctcccagggggcgggctggtccctccgggagactgcctgtctgggtaaggcctacgcccagatgtggagcctaatgtacttccaccgccgagacttgcgcttggccagtatggctatctgcagtgccgtgcccacggagtggttccctacctcgcggaccacctggtctatacacgcccaccaccagtggatgacaactgaggacatgctgaaggtgtggaatcgcgtgtggatcgaggacaaccccaacatgatcgacaagactcccgtgcatagctgggaggacatcccctacctcggtaagagggaagacctgtggtgcggctccttaatcggtctcagctcgcgcgccacctgggccaagaacatccacacggcgatcacccaggtgcggaacctgatcgggaaagaggagtacgtggactacatgccggtaatgaagcgatacagcgccccctccgagagcgagggggtgctgtga

SEQ ID NO: 26274 - RNA, 9867 nt, synthetic construct
  misc_feature 1..9867: note = derived and/or modified CDS sequence (opt11) from DENV-4__FJ882580__SS-prME
  source 1..9867: mol_type = other RNA
tcaaccatcaccttactctgcctgatccccactgtgatggcctttcacctgtccacccgcgacggcgaaccgctaatgatcgtcgccaagcacgaacgggggcgccccctgctgttcaagaccaccgaaggcataaataagtgcacgctcatcgctatggacctaggcgaaatgtgtgaagataccgtgacttacaagtgccccctgctcgttaacaccgagcccgaggacatcgactgctggtgcaacctgacgagcacctgggtcatgtacggcacgtgcacccagtccggggagcggcgacgggagaagcgcagcgttgctctgactccgcattccggcatgggtctcgagacgagggccgagacctggatgagctccgagggcgcctggaagcatgcccagcgcgtggagagctggatcctgcgaaaccccgggtttgctctgctcgccgggttcatggcctacatgatcggccagacggggatacagaggacggttttcttcgtgctgatgatgcttgtggcccccagctacggcatgcggtgtgtcggggtgggcaatcgagacttcgtggagggcgtctcaggcggggcgtgggtggatctcgtgctggagcacggcgggtgcgttacgaccatggcccagggcaagccgacgttggacttcgaactcaccaagaccaccgccaaggaggtggctctcctgcggacctactgcatcgaggccctcatctccaacatcacgaccgcgacccgctgcccgacccagggggagccctacctgaaggaggagcaggatcagcaatacatctgccggcgcgatgtggtcgaccggggctgggggaacggatgcggcctattcgggaagggcggggtggtcacgtgcgcgaagttctcttgctccggcaagatcaccgggaacctagtccaaatcgagaacctggagtataccgtggtcgtcaccgtgcataacggcgatacgcacgccgtaggaaacgacacgagcaaccacggggtgacagcgaccataacaccccgctcccccagcgtcgaggtcaaacttccggactatggcgagctcaccctggactgcgagccccggagtgggatagatttcaacgagatgatcttaatgaagatgaagaagaagacttggctcgtgcacaagcagtggttcctggacttgcccctcccctggaccaccggcgccgacacgagcgaagtgcactggaactacaaggagcgcatggtgaccttcaaggtccctcatgcgaagaggcaggatgtgacagtgctagggtcccaggagggtgccatgcactcagccctggcaggcgctaccgaagtggacagcggagacgggaaccatatgttcgcgggtcatttaaagtgcaaggtgcgcatggagaagctgcgcatcaagggcatgtcctatacgatgtgtagcggcaagttctccatcgataaggagatggccgaaacacagcacgggaccaccgtcgtgaaagtgaagtacgaaggcgccggggcgccctgcaaggtccccatcgagatacgggacgtgaataaggagcgcgtggtcggccgggtgatcagcgccacgcccctggcggagaacaccaattccgtaaccaacatcgagctcgagccgccgttcggggacagctacatcgtcatcggcgtcggtaattccgccttgaccctgcactggttccgcaaggggagctccatcggtaagatgttcgagagcacgtacagaggggccaagcgcatggccattctcggcgagaccgcgtgggacttcgggtcggtgggaggcctatttaccagcttggggaaggcagtccaccaggtttttggatcggtgtataccactatgttcggaggggtcagctggatgatccggatcctcatcgggtttctggtgctgtggatcggcaccaattcccgcaacacttccatggccatgacctgcattgctgtaggagggatcacactcttcctcggatttactgttcaggccgatatggggtgcgtagtgtcctggagcggccgcgaactgaagtgcgggtcgggaatcttcgtcgtggacaacgtgcacacctggaccgagcagtacaagttccaacccgagagcccggcgcgactggccagcgccattctgaacgcgcataaggatggcgtatgcggaatcaggtcaacgacccgcctggaaaacgtgatgtggaagcagatcaccaacgaactgaattacgtgctttgggagggcgggcatgacctgacaatcgtcgcaggcgacgtgaagggtgtgctgacgaaggggaagcgggcgttgaccccgcccgcaagcgacttaaagtactcctggaaaacctggggaaaggcgaagatattcacgccagaggcgcgaaacagcacgttcctgatcgacgggcccgacacgtccgagtgcccgaacgagcgccgcgcctggaactccttcgaggtggaggactacggcttcgggatgttcaccacaaacatttggatgaaatttcgggagggctccagcgaggtatgcgaccaccgcctcatgtccgcggcaatcaaagaccagaaagccgtgcacgccgacatgggctattggatagagagctccaagaatcagacgtggcagatcgagcgcgcgagcctaatagaagtcaagacctgcctgtggcccaaaacacacaccctctggtccaacggggtgctggagagccagatgctgatccctaagtcctatgccggcccatttagtcagcacaattaccgccagggatatgccacacagaccgtgggcccctggcacctcgggaagctagagatagactttggcgagtgccccggcaccaccgtcaccatacaggagaactgcgaccaccgcgggccaagcctgcggacgaccactgccagtgggaagctcgttacccagtggtgctgtcgctcctgcaccatgccgcccctccggtttctgggggaggacggctgctggtacgggatggagatacgacctctctccgagaaagaggagaacatggtgaagagtcaggtcaccgccggccaggggacgagcgagaccttctctatggggctgctatgcctaacgctgttcgtggaggagtgcctgaggcgccgggtcacacgcaagcacatgatcctagctgtagtgatcaccctgtgtgccatcatcctgggcggtctcacctggatggatttactgcgggccctaatcatgttaggcgatacgatgtcgggacgcatcggcggccagactcacctcgccatcatggccgtattcaaaatgtctcccgggtatgtgctaggggttttcctgcggaaactgacatcgcgcgaaactgcgctcatggtgatcggaatggccatgactaccactttgtcaatcccgcacgacctgatggagctcatcgacggcatctccctgggcctgatcctcctgaagatcgtcacccagttcgacaacacacaggtggggaccctggctctcagcctgaccttcattcgatctaccatgagcctggtgatggcctggcgcacgatcatggcagtactcttcgtggtcaccctgattcccctgtgccggacctcctgcctccagaaacaaagccactgggttgagatcactgcgctcatcctgggcgcccaggccctacccgtgtacctgatgaccttgatgaagggagcctcccgccggagctggccgctcaacgagggcattatggcggtcgggctggtttcactgctcggatcggccctgctgaaaaacgacgtgcccctcgctggtcccatggtcgccgggggcttgttactcgcggcctatgtgatgagtggtagctccgcggacctgtcccttgagaaggccgcaaacgtgcagtgggacgaaatggccgacatcaccgggagctcccccataatagaggtcaagcaagacgaggacgggtcattctctatcagggacgttgaggagaccaacatgatcactttgctggtgaagctggccttaatcactgtgagcggcctctatccccttgcgatcccgataaccatgaccctctggtatatgtggcaagtgaaaacccagcggtccggcgccctgtgggacgttcctagtcccgccgccacccaaaaggcggccctgtcggagggggtctaccgtatcatgcagcggggccttttcgggaagacgcaagtgggggtggggatccacatggagggcgtcttccacaccatgtggcacgtgaccagggggagcgtaatctgccacgagactgggcgcctggagccctcctgggctgacgtccggaacgacatgatcagctacggcggagggtggcgcctcggcgacaagtgggacaaggaggaggatgtgcaagtgctcgccatcgagccgggaaagaaccccaagcacgtccaaacgaagcccggcttattcaagaccctgaccggggagataggcgccgtcaccttagactttaagcccgggacatccggatcgccgatcatcaaccggaagggcaaggtaatcgggctgtacggcaacggggtcgtgaccaagtccggggactatgtgtctgcaatcacgcaggccgagcgcatcggggagcccgattacgaggtcgatgaggacatcttccggaaaaagcgcctaaccatcatggacttgcaccccggcgccggcaagaccaaaagaatccttccttccattgtccgcgaagcactgaagcggcgcctgcggaccttaatcttggcgcccacccgagtggtagccgccgagatggaagaggccctgcgggggcttcctatccgctaccaaacccctgccgtaaagagcgaacacacgggccgggagatcgtggatctgatgtgtcacgctaccttcaccacccgccttctatccagcacgcgggtccctaactacaatttgatcgtgatggacgaagcccatttcaccgaccccagctccgtagcagcccggggttacatcagcacccgggtggagatgggggaggccgcggccatcttcatgacagccactccacccggggcaaccgatccgttcccccagtcgaacagccccatcgaggacattgagcgcgagatccccgagcgctcatggaataccggctttgactggatcaccgactaccagggcaagacggtgtggttcgtccctagcatcaaggccgggaacgacatcgcgaactgtctgagaaagagcggaaagaaggtgattcagctcagtcgcaagacctttgacaccgaataccccaagactaagctgacggattgggatttcgtcgtaacgaccgatatctccgagatgggggcgaatttccgtgccggccgcgtgatcgacccccggcgctgcctgaagcccgtgatcctcacagatggaccggagcgggtcatcctcgccggccccatacctgtgacgcccgcgagcgccgcccagcgcagagggcgaatcgggcggaatccggcacaagaggacgaccagtacgtgttctcaggtgatccccttaagaacgacgaggaccatgcccactggaccgaggcaaagatgctcctggataatatctataccccggaagggattataccgaccctgttcggcccagagcgcgagaagacgcaggccatcgacggcgagttccgcctccgcggggagcagcggaagaccttcgtggaattaatgcgccggggcgatttgcccgtctggttgagctacaaggtagcaagtgccggaatcagctataaagaccgcgagtggtgcttcaccggcgagagaaacaaccagatactggaggagaatatggaggttgagatctggacccgcgagggcgagaagaagaagctgcggccgaagtggctcgacgcgcgcgtgtacgcggacccgatggctctgaaggacttcaaagagttcgcctcaggccgcaagtcgattacccttgatatcctcacggagatcgcttccctgccgacctatctgtcgagccgggctaaactagcgctggacaacatagtgatgttacacaccacagagcgcggcgggcgggcttaccaacatgccctcaacgagctgcccgagagcctggagacgctcatgctggtagccctgttgggagcgatgaccgccgggatatttctgttcttcatgcaaggcaaggggataggcaaactttctatgggcctcatcaccatcgccgtggcctccgggctgctgtgggtggccgagatccagccccagtggatcgcggcctcgatcatcctcgagttcttcctgatggtgctgctgatcccggagcccgagaagcagcgcacaccccaagacaaccagcttatttacgtgatcctgacgatcctcacaatcatcggacttatcgcggccaatgagatggggctgatcgagaagaccaagacggactttggcttctatcaggttaagacggagacgaccatcctcgatgtcgacttgcggcccgcctccgcgtggaccctttacgccgtggccacgacaatactcaccccgatgctgcggcacacaatcgagaatacgtccgctaacctgtcgttggccgcgatagccaaccaagcggccgtgctgatggggctaggcaagggctggcccctccaccggatggacttaggcgtccccctgctcgccatgggctgctattcacaggtgaaccccaccaccctgaccgcgtccctggtcatgttactggtccattacgccattatcgggcccggcctgcaagccaaggctacgcgcgaggcccaaaagaggacagccgccggcattatgaagaatccaaccgtggacggtattacagtgatagacctcgagcccatcagctacgaccccaagtttgagaagcaattgggccaggtcatgttacttgtgctctgtgctggacaactgctcctgatgcgtactacatgggccttttgcgaggtactgaccctcgctaccggcccgatccttaccctgtgggaggggaaccccggcaggttctggaacacgaccattgccgtctccaccgccaacatcttccgcggaagctatctcgccggggccggcctggcgttctccttaataaagaacgcacagacgccccggcgcggaaccggcaccaccggagagacgctcggggagaaatggaagcggcagctgaacagccttgaccgcaaggagttcgaggagtacaagcgctccggcatcctagaggtagaccgaacggaagccaagagcgccttaaaggacgggtccaagatcaagcacgccgtgagcagaggatccagcaagatccgatggatagtcgagcgcggaatggtgaagcctaagggcaaggtggtcgatttggggtgcggtcgtggtggttggtcctactacatggcgacgctcaagaatgtgaccgaggtgaaaggctacaccaaagggggcccagggcacgaggagcccatccccatggcaacgtacggttggaacctggtcaaacttcacagcggcgtcgatgtgttctataagcctaccgagcaggttgacaccctcttatgcgacatcggggagagctcctcaaatcccacgatagaggagggccggactcttcgggtgctcaagatggtggagccctggctgtccagcaagcccgagttctgcataaaggtcttaaacccctacatgccaactgtgatcgaggagctagaaaaattacagcgcaagcacggtggaaacttagtgcggtgccccctctcccgcaacagcacccacgagatgtactgggtctccggcgcctcaggtaacatcgtgagttcagttaacaccacgtccaagatgctcctgaacaggttcacgaccaggcaccgaaagcccacctacgaaaaggacgtcgacctgggcgccgggacgcgcagcgtgtccaccgaaaccgaaaagcctgacatgaccatcataggccggcgcctccagcgactacaggaggagcacaaggaaacgtggcattacgaccaggagaatccgtacaggacctgggcgtatcatgggagctacgaagccccctccaccggcagcgccagtagcatggtaaatggcgtagtgaaactgttaaccaaaccctgggacgtaatcccgatggttacgcaactggccatgaccgacaccacgcccttcgggcagcaacgagtgttcaaggagaaggtcgatacgcgcacaccccaacccaagcccggaacccgcatggtcatgaccacgaccgccaattggctatgggcgctcctagggaagaagaaaaatccccgcttatgcacccgggaagagttcatttccaaggtgcgctccaacgccgccatcggcgccgtattccaggaggagcaggggtggaccagcgcttccgaggcagtgaacgacagccggttctgggagctcgttgacaaggagcgcgccctgcaccaggaaggtaagtgtgagtcctgcgtctataacatgatgggcaagcgtgagaagaagctgggtgagttcggccgggccaagggcagccgcgccatctggtatatgtggctcggcgcccggttcctggagttcgaggcgttagggttcctcaatgaggaccactggttcggccgcgagaacagttggagcggcgtggagggggaggggctgcatagactcggatatatcttagaagagatcgacaagaaggacggtgacctgatgtacgccgacgacacggccggatgggacacacgcatcaccgaggatgacctgcagaacgaggagctcattactgagcagatggcaccccaccacaagatcctggcgaaggccatcttcaaactgacctaccagaataaggtggtcaaggtgctccggcccacgccgcgcggggccgtgatggacataatatcccggaaggaccagcgcggcagcggacaggtcggtacctatgggctgaacaccttcaccaacatggaggtgcagctgatacggcaaatggaggccgagggcgtgatcacgcaagacgatatgcagaatcccaagggcctcaaggagcgcgtcgagaagtggctgcgggagtgcggggtggataggctaaagcggatggcgatctctggcgatgactgcgtcgtcaagcccctcgatgaacgcttcgggaccagcctgctattcctcaacgatatgggcaaagtgcggaaagacatcccgcagtgggagccgagcaaggggtggaagaactggcaggaggtgccattctgcagccaccacttccacaagatcttcatgaaggacggacggtcactggtcgtgccctgcagaaatcaggacgagctgattggcagggcgcgcataagccagggggctggctggagcctaagagagaccgcgtgcctggggaaggcttacgcccaaatgtggtcgctgatgtatttccaccgccgggacctccgcctggcgtccatggcaatatgcagcgctgtgcccacggagtggttcccgacgagccgtaccacttggtccatccatgcccaccaccagtggatgaccaccgaggatatgttaaaagtttggaaccgcgtttggatagaggacaaccccaacatgatcgacaagacacccgtgcacagctgggaggacatcccctatctaggcaaacgggaggacttatggtgcgggtccttaattggcctcagctctcgcgccacctgggctaagaacattcacaccgccataacgcaggtccggaacttaatcggcaaagaggagtacgtggactacatgccggtgatgaaacggtacagcgccccgtcggaatccgaaggggttctgtga

SEQ ID NO: 26275 - RNA, 9867 nt, synthetic construct
  misc_feature 1..9867: note = derived and/or modified CDS sequence (opt11) from DENV-4__FJ882581__SS-prME
  source 1..9867: mol_type = other RNA
tcgaccattactcttctatgcttgatccccacggtgatggcctttcatctctcgacccgagatggcgaaccgctcatgatcgtcgccaagcacgaacggggccgcccactcctcttcaaaaccaccgagggcatcaacaagtgcacgctcatcgcgatggacctgggggaaatgtgcgaagacaccgtcacctacaagtgccccctgctcgttaacacggagcccgaggacatcgattgttggtgcaatctgacgagcacctgggtcatgtacggaacctgcacccagtccggggagcggcgccgtgagaagcggagcgtggccctgacgccgcactcgggcatgggcctcgagacccgggcggagacctggatgagcagtgagggggcctggaagcacgctcagagggttgagtcttggatcctgcggaaccccggcttcgcgctgctcgccgggttcatggcttacatgatcggtcagaccgggatacagcggacggtcttcttcgtgctgatgatgctggtggccccctcctacggcatgcgctgcgtcggcgtgggtaacagggacttcgtggagggcgtcagcggtggcgcgtgggttgacctcgtgctggagcatggcgggtgcgtcactaccatggcccagggcaaacccaccctggactttgagctcacgaagaccaccgcgaaggaggtggccctgctgcggacctactgcatcgaagcgctcatctccaacatcactaccgccacccgctgcccgacccagggggaaccctatctgaaagaggagcaggaccaacagtacatctgccgtcgagatgtggtcgaccggggctgggggaacggctgcggcctgttcgggaagggcggggttgtgacctgcgctaagttctcctgctccggcaagatcaccggtaacttagtccagatcgagaacctggagtacaccgtcgtcgtaaccgtgcacaacggcgatacgcacgccgtcggcaacgacacaagcaaccacggtgtgaccgcgaccatcacaccccggtccccctccgtggaggtcaagctgcccgactacggcgagctcaccctggactgcgagccccggagtgggatcgacttcaacgagatgatcctgatgaaaatgaagaagaagacttggctcgtgcacaagcagtggtttttggacttgcccctcccttggacaaccggcgcagacactagcgaggtgcactggaactacaaagaacggatggtcacctttaaggtgccgcacgcgaagcggcaggacgtgaccgtgctggggagccaggagggcgcaatgcacagcgccctggccggcgccaccgaagtggacagtggggacggcaaccatatgttcgcggggcatcttaagtgcaaggttcgcatggagaagctccgcatcaagggcatgtcctatacgatgtgcagcggcaagttctccatcgacaaggagatggccgagacccagcacgggaccacggtggtgaaggtcaagtacgagggcgcgggggcaccctgcaaagtccccatcgagatacgggacgtgaacaaggagaaggtagtcggccgcgtgatcagcgccacgcccctggcggagaacaccaattccgtgaccaacatcgagctcgaaccgcccttcggtgacagttacatcgtcatcggcgtgggcaactcagccctgaccctgcactggttccggaaggggagctccatcggcaagatgttcgagagcacatacagaggggcgaagcggatggcaatcctcggcgagaccgcgtgggatttcgggagtgtaggcggcctgttcactagcctggggaaggcagttcaccaagtgttcggcagcgtctacacgacaatgtttggaggggtcagctggatgatacgcatcctcatcgggttcctggtgctgtggatcgggacaaactccaggaataccagcatggccatgacctgcatagccgtgggcgggataacgctgttcctcggcttcaccgtccaggcagacatgggctgcgtggtgtcctggaatggccgcgagctcaagtgcgggtctggcatctttgttgtcgacaacgtccacacgtggaccgagcagtacaagttccagcccgagtcccccgctcggctggccagcgccatcttgaacgcccacaaggacggggtttgcgggatccgtagcacgacccggctggaaaacgtgatgtggaagcagatcacgaacgagctgaactacgtgttgtgggagggcgggcacgacctgaccgtggtggccggcgacgtgaagggcgtcctgacgaaggggaagcgggctctcaccccgccagcctccgacctgaagtacagctggaagacctggggcaaggccaagatcttcacccccgaggcccggaactccaccttcctgatcgacgggccagacacgagcgagtgcccgaatgagcggcgggcctggaactccttcgaagtcgaagactacgggttcgggatgttcactacaaacatctggatgaagttccgggaggggagctccgaggtgtgcgaccatcggctcatgagcgccgccataaaggaccagaaggccgtccacgccgacatgggctactggatagagtccagcaagaaccagacgtggcagatcgagagagcgtcactgatagaggtcaagacctgcctgtggcccaagacccataccctctggagcaacggggtgctggagtcccagatgctgatacccaagagctacgccggaccgttctcacaacacaactaccgtcaggggtacgctacgcaaaccgttggcccctggcacctaggaaagctggagatcgacttcggcgagtgccctggaaccacagtgacaatccaagagaattgcgaccatcgcgggccaagtctgcgcacgaccaccgcgtccggcaagctcgtgacccagtggtgctgccggtcttgcacgatgccacccctgcgattcttgggtgaggacggctgctggtatgggatggagatccgacccctctccgagaaggaggaaaacatggtcaaaagccaggtgaccgccgggcaaggcacctccgagaccttttccatggggctgctttgcctcacgctgttcgttgaggagtgtctgcgccgtcgcgtgacgcgaaagcacatgatcctcgctgtggtcatcaccctgtgcgccatcatacttggcgggttaacctggatggacctgctgcgcgctctgataatgctgggcgacacgatgagcggccggatcgggggccagacccatctggccatcatggccgtcttcaagatgtcccccgggtacgtgctcggagtctttttgcgcaagctgactagccgggagaccgcgctcatggtgatcgggatggcgatgacgaccacgttatccatcccgcacgacttgatggagttgatcgacggcatcagcctggggctgatcctcctgaagatcgtgacccagttcgacaatacgcaggtcggcaccctggccctcagtctgaccttcatacgctccacaatgtcgctggtgatggcctggcgcacgatcatggccgtgctgtttgttgtgaccctgatccccctgtgccgcactagctgcttacagaaacagtctcactgggtcgaaatcacggcgctgatcctaggcgcccaggccctcccggtctacctgatgacgctgatgaaaggagccagccggcgatcctggcccctcaacgagggcatcatggcggtggggctggtgagcctgctcgggtccgccctgctcaaaaatgacgtcccgctcgccggccccatggtggccgggggcctgctgctcgccgcgtacgtgatgagcgggtccagcgccgacctaagcctggagaaggccgcgaacgtccaatgggacgagatggccgacatcaccggttcctctcctataatcgaagttaagcaggacgaagacggctccttcagcatccgggacgtggaggaaaccaacatgattacattactggtcaagctggcgctcatcacggtgtccggcttatatccactggccatcccgataaccatgactctctggtatatgtggcaagtgaagacccagcgcagcggcgccctgtgggacgttccatcccccgccgccacccagaaggcagcccttagcgagggggtctaccggatcatgcagcgcggtctattcgggaagacacaggtgggcgtcgggattcacatggagggcgtgtttcacaccatgtggcacgtgacccggggctcggtcatctgccacgagaccgggcgcctggagccaagctgggccgacgtgcgcaacgacatgatctcctacggcgggggctggcggctgggagacaagtgggacaaggaggaggacgttcaggtccttgccatcgagccggggaagaaccccaagcacgtccagacgaagcccggcctgttcaagaccctgaccggtgagatcggggccgtgacactcgatttcaagcccggtacaagcggctcccccataatcaaccgcaaggggaaggtcatcgggctgtatggcaatggggtagtgaccaagagtggtgactatgtctccgcgatcacccaggcggagcggatcggggaacctgactacgaggtagacgaggacatcttcagaaagaagcggctgaccatcatggacctccaccccggcgccgggaagacgaaacgcatcctgccgtcaatcgtgcgggaggcgctcaagcgccggctgcgcacccttatcctggctcccactcgggtcgtggccgccgagatggaagaagccctgcgcggcctacccatccggtaccaaacccccgccgtgaagtcggagcatactggccgcgagatcgtcgacttgatgtgtcatgctaccttcacaacccggctgctcagctccacgcgcgtgcctaactacaacctcatcgtgatggacgaagcccacttcaccgacccgagcagcgtcgcagcccgggggtacatctccacccgagtggagatgggcgaggccgcggccatattcatgaccgcgacgccacctggagccaccgaccctttcccacagagcaactcccccatcgaagacatcgaacgcgagatccccgagcgcagctggaacaccggcttcgactggattacggactaccagggcaagacagtctggttcgtgccctccatcaaggccgggaacgacatcgcgaactgcctgcgcaagagcggcaagaaggtgatccagctctcacggaagactttcgacaccgagtaccccaagaccaaactgactgactgggatttcgtcgtgactaccgatatcagcgagatgggggccaacttccgcgccggccgggtgatcgacccccgacgttgtctcaagcccgtcatacttacggacgggccggagcgcgtgatcctggccggccccatccccgtcacacccgcgagtgcggcccagcggcgcggccggatcggtcgcaacctggcccaggaggacgaccagtatgtcttctctggcgaccccctcaagaatgacgaggaccacgcccactggaccgaggcgaagatgctattggacaacatctacacccccgaggggatcatccccaccctctttggtcccgagcgggaaaagacgcaggccattgacggggagttccgcctgcggggagagcagcgcaagactttcgtggaactgatgcggcgaggtgatttgccggtgtggctgtcctacaaggtcgccagcgccgggatatcctacaaggaccgggagtggtgcttcaccggcgagcgcaacaaccagatactggaggagaacatggaagtggagatctggacccgagagggggaaaagaagaaactccgcccaaagtggctggacgcacgggtgtacgccgacccgatggccctgaaggacttcaaggagttcgccagcgggcgcaagtccattaccctcgacatcctgacggagatcgccagcctgcccacatacctctcgagccgggccaagctggcgctggataacatcgtcatgctccataccaccgagcggggcggacgcgcataccagcacgccctgaacgagctgccggaatccttggagacgctgatgctggtggccctcctgggcgcgatgaccgccgggatcttccttttcttcatgcagggaaagggaataggcaagctcagcatgggcctgataaccattgccgtagctagcgggctgctctgggtagccgagatccaaccacagtggatagctgcctccatcatcctggagttcttcctgatggtgctgctgatacctgagccggagaagcagcggacaccccaggacaaccagctgatctacgtgatcctcacgatcctgaccatcatcggcctgatcgccgctaacgagatgggcttaatagagaaaaccaaaaccgatttcgggttctaccaggttaagacggagaccaccatcctggacgtggacctaagaccagccagcgcttggaccctctacgccgttgccacgactatcctgacccccatgctgcggcacaccattgagaacacatccgctaacctcagcctggccgcaatcgcaaatcaggccgcggtcctcatggggctcggtaagggctggccgctgcaccgcatggacctaggggttcccctcctggccatgggctgctattcccaggtaaaccccaccactctaaccgcgagcctcgtcatgctgcttgttcattacgctataatagggcctggcctccaggccaaggcaacgcgggaggcgcagaagcgcaccgcagccggcatcatgaagaacccgaccgtggatgggatcacggtaatcgacctggagccgatctcctacgaccccaagtttgagaagcaactgggacaggtgatgctcttggtgctgtgcgccgggcaactcctgctgatgcgcacgacctgggccttctgcgaagtcctcaccctggcgaccggcccaatcctgacactctgggaggggaacccgggccgcttctggaacaccaccatagcggtgagtaccgctaacatctttcgggggtcctacctggccggggccggtctggcattcagcctcatcaagaacgcccagacgccccgccgggggaccgggacgaccggggagaccctgggcgagaagtggaagcgccaactgaactcgctcgaccggaaggagttcgaggagtacaagcgcagcggcatactcgaggtggaccgtacggaggccaagtccgccttaaaggatgggagcaagatcaagcacgccgtcagcaggggcagctccaagatccggtggatcgtggagaggggcatggtgaagcccaagggcaaggtcgtggacctcgggtgcggacgcggcgggtggagctactacatggcgaccctgaagaacgtgactgaggtcaaggggtacacaaaagggggccccgggcacgaggagcccattcccatggcaacgtacggatggaacttagtcaagctgcactccggtgtagatgtcttctacaagcccaccgagcaagttgatactctgctgtgcgacatcggtgagtcaagctcaaatcccaccatcgaggagggccggacgctccgcgtgcttaagatggtcgagccgtggctgtcttccaagcccgagttctgcatcaaggtgctgaacccctatatgcccaccgttatcgaggagcttgagaagctacagcggaagcacggcggcaacctcgtccgctgcccgctcagccggaactcgacgcatgagatgtactgggtgagcggagcctctggtaacattgtttcatccgtcaacaccacgagcaagatgctgctaaaccgcttcaccacccggcaccggaagcccacctatgagaaggacgtagacctcggcgccgggacccggtccgtcagtaccgagacagagaagcccgacatgaccatcataggccgccgcctgcagcgcctgcaggaggagcacaaggagacgtggcactacgaccaggagaacccctaccggacctgggcgtaccacgggtcctacgaagccccgtcgacaggatccgccagttcaatggtgaacggagtggtcaagctcctgaccaagccctgggacgtgatccctatggtgacgcaactggccatgactgataccacgccattcggacagcaacgtgttttcaaggagaaggtggacactcggacaccccagcccaagccaggcacacgcatggtgatgaccactacagccaactggctctgggcgctgctgggaaagaagaagaacccgcggctctgcaccagggaggagttcataagcaaagtccgaagtaacgccgccataggcgccgtgttccaggaggaacaggggtggaccagcgccagcgaggcggtgaacgactccaggttctgggagttggtcgacaaggagcgggccctgcaccaggagggcaagtgcgaatcctgcgtgtacaacatgatgggtaagcgagagaaaaagctcggggagttcggccgcgccaaagggagccgtgccatctggtacatgtggttgggagcccgcttcctggagttcgaggcacttggctttctgaacgaggatcactggttcggccgggagaacagctggagcggcgtagagggggaaggcctccaccgcctcgggtacatcctggaggagatagacaagaaggacggcgacctgatgtacgccgacgacacggccggctgggacacccggatcaccgaagacgacttgcagaacgaggagctgatcaccgagcagatggctccccaccacaagatcttggcgaaggccattttcaagttgacctaccagaataaggtcgtgaaggtgctgcgccccacgccccggggagccgtcatggacatcattagccgaaaggaccagcggggctccgggcaggtaggaacctatggtctcaataccttcaccaacatggaagtgcagctcatccggcagatggaggccgagggcgtcatcacgcaagacgacatgcagaacccgaagggcctgaaggagcgggtggagaagtggctgcgcgagtgcggggtggaccggttgaagcgcatggccatcagcggcgacgactgcgtcgtgaaacccctggacgagcgtttcgggacctccctcctgttcctgaacgacatgggcaaagtgcgcaaggatatcccgcagtgggagcccagcaagggatggaagaactggcaggaggtcccgttctgctcccatcacttccacaaaatcttcatgaaggacggccggagcttagtggtgccctgtaggaaccaggacgagctcatcggtcgggcgcgtatctcccagggggccggctggagcctgcgcgaaaccgcctgcctggggaaggcctacgcccagatgtggtccctcatgtacttccaccgtcgcgacctgcggctggcaagcatggcgatctgctccgccgtccccaccgagtggtttccaacgagccgaaccacctggagcatccacgcccaccaccagtggatgactacggaggacatgctcaaggtttggaacagagtgtggatcgaggacaatccgaatatgatcgacaagacgcccgtccactcctgggaggacatcccatacctgggcaagcgcgaagatctgtggtgcgggagcctcatcggcttatcctcccgggccacctgggcgaagaacatccacacggccatcactcaggtgagaaacctcatcggcaaagaagagtacgtggactacatgcccgtcatgaagcgctactccgctccgagcgagtccgagggggtgctctag

SEQ ID NO: 26276 - RNA, 9867 nt, synthetic construct
  misc_feature 1..9867: note = derived and/or modified CDS sequence (opt11) from DENV-4__FJ882582__SS-prME
  source 1..9867: mol_type = other RNA
agcactatcacccttctctgcctaataccgacagtcatggccttccatctgagcacccgcgacggggagccgctcatgattgtcgccaagcatgagcgggggcgccctctgctgttcaagaccactgagggcatcaacaagtgtactttaatcgcgatggacctgggggagatgtgcgaggacacagtcacttacaagtgccccctgctcgtgaatactgagcccgaggacatagactgctggtgcaacctgacgagtacctgggttatgtacgggacctgtacccaatccggggagcggcgccgggaaaagagaagcgtggccctgacgccacactccggcatgggcctcgagacacgagcagagacatggatgagctccgagggagcctggaaacacgcacagcgggtggagagctggatcctgaggaaccccggatttgcgctgctagccggattcatggcctatatgatcggacagaccgggatccagcgcacagtcttctttgttctgatgatgctggtggcccccagttacggtatgagatgcgtcggtgtagggaatcgcgacttcgtggagggcgtcagcgggggagcgtgggtggacctcgtgctggaacatggcgggtgtgtcaccaccatggcccaaggcaagcccaccctggacttcgagcttacgaagaccacagcaaaggaggtggccctactgcggacctattgcattgaggccctcatctcgaacatcacgaccgctacccgctgcccgacccagggtgagccctatctgaaggaggagcaagaccagcaatacatttgccggcgcgatgtagttgaccgaggctgggggaacggctgcggcctgttcgggaagggcggggtggtaacgtgcgcaaaattctcgtgctctggcaagattacggggaacctcgtccagattgaaaatttagagtacaccgtggttgtcactgtgcacaacggcgacacccacgccgtcggcaacgacacgagcaaccatggggtgaccgccaccatcacgccccggtcacccagcgtggaagtcaaactgccggattatggcgagctcaccctcgactgtgagccaaggtctggaatcgacttcaacgagatgatccttatgaagatgaagaagaagacctggctcgtgcacaagcagtggtttctggacctgccactcccctggacaacgggcgccgacacgagcgaagtgcactggaattacaaggagcgcatggtcaccttcaaggtgccgcacgcgaaacggcaagacgtaaccgtcctggggtcccaggagggggccatgcactcagccctggccggcgccaccgaagtcgacagcggggacggcaatcacatgttcgctggtcatctcaaatgcaaggtacgcatggagaagctgcgcattaaggggatgtcctatacgatgtgcagcggcaagttctcgatcgacaaggaaatggctgagacccagcacggaactaccgtcgtgaaggtgaagtacgagggggccggggcaccctgcaaggtcccgatcgaaatccgtgacgtgaataaggaaaaggtggtaggcagggttatcagcgctacgcccctggcggagaacaccaactccgtgaccaacatcgagctcgagccccccttcggcgacagctacattgtcatcggtgttggcaactctgccttgacgctgcactggtttcggaaggggtcttccatcggaaagatgttcgagtcgacgtatcgtggggccaagcggatggccatcctcggcgaaaccgcgtgggacttcgggagcgttggtgggctgtttacgagcctgggaaaggccgtccatcaggtgtttggctccgtttatacaacgatgttcgggggcgtcagctggatgatcagaatcctcatcgggtttctagtgctatggatcggcaccaactcccggaacaccagcatggccatgacctgcatcgccgtgggggggataactctgttcctcggatttaccgtccaggccgacatggggtgcgtggtgtcctggaacggacgcgagctaaagtgtgggagcggtatcttcgtcgtggataacgtgcacacctggaccgagcaatacaagttccaaccagagtctccggcacggctggcctcggccatcctcaacgcccacaaggacggcgtctgcgggatcaggagcacgacccggctagagaacgttatgtggaagcaaatcacaaacgaactgaactacgtgctctgggagggcgggcatgacctgacggtcgtggccggcgacgtgaagggcgtcctcacgaaagggaagcgcgccctcacgccgcccgcatccgaccttaagtacagctggaagacctggggcaaggccaagatcttcactcccgaggcacgaaacagtacgttcctgatcgacgggcccgacacaagcgaatgcccgaacgagagacgggcttggaattccttcgaggtagaggactacggcttcgggatgttcactacaaatatctggatgaagttccgtgagggttcctccgaagtgtgcgaccaccggctgatgagcgcggccatcaaggaccagaaagccgttcatgccgacatggggtattggatcgaatccagcaagaaccaaacgtggcagatagaacgcgcgtccctgatcgaagtgaagacctgtctgtggcccaagacccacaccctgtggtcaaacggggtgctcgagtcccagatgcttatccccaagtcgtatgccggcccattctcccagcacaactaccggcaggggtatgccacccaaactgtcggcccctggcacctcgggaagctggaaattgatttcggcgagtgtcccggcaccaccgtgaccattcaggagaattgcgaccatcgcggtccctcgctacgcacgaccacggcctcgggcaaattggtaacgcagtggtgctgccggagctgcactatgccgcccttacgcttcctgggggaggatggctgctggtacgggatggagatcagacccctcagcgagaaggaggagaacatggttaaatctcaggtgaccgcggggcagggtaccagcgaaacattctctatggggctgttgtgtctcacgctttttgtcgaggaatgcctgcggcgacgcgttacgagaaagcatatgatccttgcggtggttatcaccctttgcgccatcatcctgggcgggctcacctggatggacctgctgcgcgccctcatcatgctgggcgacactatgtcaggtcggatcgggggccagacccacctggccatcatggccgtattcaagatgtcaccagggtatgtgctcggagttttcctgaggaagctgaccagcagggaaacggcgctcatggtgatcgggatggccatgacgaccaccctgtccatcccccacgacctgatggagctcatcgacggcatcagcctgggcctgattctcctgaagattgttacccaattcgacaacacgcaggtcgggaccctggccctctccctgacctttatccgcagtaccatgtccctggttatggcatggcggaccatcatggccgtactcttcgttgtgaccctgatccccctatgccgcaccagctgcctccaaaagcagtcacattgggtggagatcacagcgctgatactcggcgcccaagccctccccgtctaccttatgacgctgatgaagggggccagtcgccgctcctggccactcaacgagggcataatggcggttgggctggttagcctgctcggctccgccctgctgaagaacgacgtccctctcgctggcccaatggtggccggcggtctcctgctcgccgcttacgtcatgtccgggtcaagcgctgacctgagcctggagaaggcagccaacgtccagtgggacgagatggcagatatcaccgggtcgagccccatcatcgaggtgaagcaggatgaggacgggtccttctcgatccgggacgtggaggagaccaacatgatcacgctcctggtcaagctggcattgattacggtgtccggcttataccccctggccataccgataactatgaccctctggtacatgtggcaggtgaagacacagcgcagcggtgccctgtgggacgtcccatcccccgccgccacacaaaaggcggccctgtcagaaggggtctatcggatcatgcagcgcggcctcttcgggaagacgcaggtgggtgtcgggatccacatggagggcgtgttccataccatgtggcacgttacgcggggctccgtaatctgccacgaaacagggcggctggagcctagctgggctgatgtacgcaacgacatgatcagctatggcggcggctggcggctgggcgacaagtgggacaaagaggaagacgtgcaggtcctcgctatcgagccgggtaagaaccccaaacacgtgcagacgaagccgggcctgttcaagaccctgaccggggagataggcgccgtgaccctcgacttcaagcccgggacgtccggctccccaattatcaaccgcaagggcaaggtcattggtctttacggaaacggcgtcgtgaccaagtcgggcgactatgtctccgcgatcacccaagcggagaggatcggggaacccgactacgaggtggacgaagacatcttccgtaaaaagcgcctgaccatcatggacctccacccaggcgccggtaagacgaaaaggatcctgccgagcatagttcgggaggccctgaagaggcggctgcgcactcttatcttagcgccgacccgggttgtcgctgccgagatggaggaggctctacgcgggctcccaatccggtaccagacccccgccgttaaatccgaacacacgggccgcgagatcgtcgatctgatgtgccacgcgaccttcaccacccggctgctctcatccacccgcgtaccgaattacaaccttatcgtgatggacgaggcgcacttcacggacccgagcagcgtcgccgcccgggggtacatatccacccgagtggagatgggcgaggccgccgccatcttcatgaccgctacgccccccggcgccaccgacccgtttccccagagcaacagccccatcgaggacatcgagcgggagatcccggagcgcagctggaataccggatttgactggatcactgattaccaggggaaaacggtctggttcgtcccttccatcaaggcggggaatgacatcgcgaactgcctgcgcaaaagtggcaagaaggttatccagctatcaagaaaaaccttcgacaccgagtatcccaagaccaagctgacggactgggacttcgtagtcaccacggacatctccgagatgggggcgaacttccgcgcaggcagggttatcgacccacgccggtgcttaaaacccgtcatcctcaccgacgggccggaacgcgtgatcctggcaggccccatacccgtcacgcccgcgtccgccgcccaacggcgcggccggatcggtcgcaacctggctcaggaggacgatcagtacgtcttcagcggcgacccgctcaagaacgatgaggaccacgcacactggaccgaggcgaaaatgctgctggacaatatctacactcccgaggggatcattcccacccttttcggcccagagcgggagaagacgcaggccatcgacggcgagttccggctgcggggcgagcagcgcaagacattcgttgagctgatgcggaggggcgatctcccggtatggctgtcctacaaggtggcaagcgccgggatctcctacaaggacagggagtggtgcttcaccggtgagcgcaacaaccagatcttagaggagaacatggaagtagagatttggacccgagagggggagaaaaagaagctccgccccaagtggctggatgcccgggtgtacgcagatcccatggctctgaaggactttaaggagttcgccagcggcaggaagtccattactctcgacatcctgacggagatcgcctctttacccacctacctctcaagccgcgccaagctggcgctggacaacatcgtcatgctacacaccaccgagcggggcgggcgcgcctatcagcacgccctcaacgagctgcccgagtccctcgagacgctgatgctggtggccctcctgggcgcaatgacggccgggatcttcctgttcttcatgcagggcaagggaatcgggaagctcagcatgggtctgatcaccatcgcagtggccagcgggcttttatgggtggccgagatacagccccaatggatcgccgcgagtataatccttgagttcttcttgatggtgctcctgatccccgagccggaaaaacagcggaccccccaggacaaccagctgatctacgtgatcctcacgatcctgactatcatcggattaatcgcggccaatgagatggggctcatcgagaaaacgaagaccgacttcggcttctaccaggtaaagacagaaacgaccatccttgacgtggacctgcgcccagcaagcgcgtggaccctatatgctgtggcgacgacgatcctgaccccaatgctgcggcacaccatcgaaaacacgtccgcaaacctcagcctggccgcgattgccaatcaggccgccgtcctgatgggcctcggcaagggttggcccttacaccgcatggacctgggggtgcccctcctggccatgggctgttactcacaggtgaaccccaccaccctaacggcgagcctcgtcatgcttttggtacattacgctatcatcggacccggactccaggccaaggccaccagagaggcacagaagcgcaccgccgccggcatcatgaagaacccgaccgtggacgggatcaccgtcattgacctggagcccatttcgtacgatcccaagttcgaaaagcagctgggccaggtcatgctactggtcctgtgcgcggggcagctcctgttaatgcggacgacctgggcattttgtgaagtcttgacgttagcgaccggccctatcctgacattatgggaggggaacccgggacggttttggaacaccaccatcgccgtgagcaccgcaaacattttccggggctcttacctggccggggcaggtctggcgttcagcctcattaaaaatgcccagacgccccgccggggaaccggcacgaccggggaaaccctgggcgaaaagtggaaacgccaactgaactccctcgaccggaaggagttcgaggaatataagcgctcaggcatcctggaggtggaccggacagaggccaagtccgccctgaaggacgggagcaagatcaaacacgcagtatcccgcggaagctccaagatcaggtggatagtggagcgcgggatggtcaagcccaaggggaaggtagtggaccttggttgtggccgcggcgggtggagctactacatggctaccttaaagaacgtcacagaggtgaagggctacaccaaggggggccccgggcacgaggagccgatccccatggccacgtacgggtggaacctggtgaagctccattccggggttgatgtcttctacaagcccaccgagcaggtggacaccctcctgtgcgacatcggggaatcaagctccaaccccaccattgaggaaggccggaccctcagagttttgaagatggtagagccgtggctgtcatccaagcccgaattctgcatcaaggtgctgaacccctatatgcccaccgtcatagaagagctcgagaagctgcagcggaagcacggaggcaacctggttcgctgtccgctcagccggaactccacacacgagatgtattgggtgagcggcgcctccggaaacatcgtcagcagcgtgaacaccacgagtaagatgctgctgaaccgtttcaccacccggcatcgcaaacccacctacgagaaggacgtggacctcggcgctggaactcggagcgtcagtaccgagaccgagaagcccgacatgaccatcatcggccgccggctgcagcggctgcaggaggagcataaggagacttggcactacgaccaggagaacccctaccggacgtgggcgtaccatgggtcctatgaggccccgagcaccggcagtgccagttcgatggtgaatggggttgtcaagctcctcaccaagccatgggacgtgatcccaatggtgacgcagctggccatgaccgataccaccccattcggtcagcagcgcgtcttcaaggagaaggtggacacgcggaccccccagcccaagcccggcacgcgcatggttatgaccacgacagccaactggctctgggctttgttggggaagaagaagaacccgcggctctgcacccgcgaagagtttatcagcaaagtccggtccaatgcagccatcggcgccgtgttccaggaggagcaagggtggacctcggccagcgaggcggtgaacgactcccgcttctgggaactggtcgacaaagagcgggccctgcaccaagagggcaagtgcgaatcgtgcgtgtacaacatgatgggcaagcgcgagaagaagcttggggagttcggtcgcgccaaggggtcccgggccatctggtacatgtggctgggcgcccgcttcctggagttcgaggcattagggttcctgaacgaggaccactggttcggtcgggaaaacagctggagcggcgtggagggggaggggctgcaccgcctcgggtacattctggaagagatcgataagaaggacggcgatctgatgtacgctgacgacacggcggggtgggacactcggatcactgaagacgacctccagaatgaagagttaatcaccgagcagatggccccccaccacaagatcctagcgaaagccatcttcaagctcacctaccagaacaaggtggtaaaggtgctgcggcctacgcccagaggcgccgtcatggacatcatctcgcgcaaggatcaacggggcagcggtcaggtgggcacgtacgggctgaacaccttcaccaacatggaggtacagctcatccgacagatggaggcggagggagttataacgcaagacgacatgcaaaacccgaagggactgaaggagcgtgtggagaagtggttgcgcgagtgcggggtggacagactaaagcgcatggccatcagcggtgacgattgcgtcgtgaagccactggacgaacggtttgggacctccctactcttcctgaacgacatgggcaaggtacgcaaggacatcccacagtgggagcccagcaaggggtggaagaactggcaagaggtcccgttctgctcccaccatttccacaagatcttcatgaaagacggccggagcttagttgtcccatgccgcaaccaagacgagctaatcggccgggcgcgaatatcccaaggggccggatggagcttgcgtgagacggcctgtttagggaaggcatacgcccagatgtggtccctcatgtatttccaccggcgcgatctacggctcgccagcatggccatttgctccgccgtcccaaccgagtggtttcccacgagcagaaccacctggagcatccacgcccaccaccaatggatgacaacggaggatatgctcaaggtttggaaccgggtgtggatcgaggataacccaaacatgatagacaagacccccgtgcattcctgggaggacatcccctacctgggcaagcgcgaggacctgtggtgcgggagcctcattggcctgtccagccgagccacctgggcgaagaacatccacaccgccatcacccaggtgcgcaacctcatcggcaaggaggagtatgcggactacatgcccgtgatgaagcggtactcagcccccagcgagtccgagggggtcctctga

SEQ ID NO: 26277 - RNA, 9867 nt, synthetic construct
  misc_feature 1..9867: note = derived and/or modified CDS sequence (opt11) from DENV-4__FJ882584__SS-prME
  source 1..9867: mol_type = other RNA
tcgaccattaccctgctctgcctaatccccacggtgatggccttccacctgtcaaccagagacggtgagccgctgatgatcgtagctaagcatgagcgggggcgccccttacttttcaagaccaccgaagggatcaataagtgcacgctgatcgcgatggacctgggagagatgtgcgaggatacagtgacctacaagtgccctctgttagtgaacacagagcccgaggacattgactgttggtgcaacctgacgtctacctgggtcatgtatggtacctgcacccagtccggggagcggcgccgggagaagcgcagcgtggcactgacgccccacagcggcatgggcctggaaacccgggccgaaacgtggatgagctccgaaggggcctggaagcacgctcaacgtgtggagagttggatcctaagaaaccccggcttcgcgctgctagccgggttcatggcctatatgatcgggcagaccgggatccagagaaccgttttcttcgtcctgatgatgctggtggctcccagttacggcatgcggtgtgtcggcgtagggaaccgcgacttcgtcgaaggcgtctctggaggcgcgtgggtggacctcgtcttagagcacggcggttgcgtgactaccatggcacagggcaagcccaccctggacttcgaattgactaagaccaccgccaaggaggtggccctgttacggacgtactgcatcgaagcatccatctccaacatcacgaccgcgacccgctgcccgacccagggggagccctacttgaaagaggagcaggaccaacagtatatctgccggcgcgacgtggtggaccggggatggggtaacgggtgtggcctgttcgggaaaggcggggtagtaacgtgcgccaaattctcctgcagcggcaaaatcaccgggaacctggtgcagatcgagaacctagaatacaccgtggtggtaactgtgcataacggtgacacacacgcagtcggcaatgacacctccaaccatggcgtaacggccaccatcacgccaagaagtccgtcagtggaggtcaaacttccggattatggggagctgaccctcgattgcgagccacgttccgggatcgactttaatgagatgatccttatgaagatgaagaaaaagacctggctggttcacaagcagtggttcctggacctgcccctgccctggactacaggggcagatacgtccgaggtgcactggaactacaaagagcgcatggtcaccttcaaggtgccccatgcaaagcgtcaagacgtgacagtcctcggctcacaagagggcgccatgcactctgcactggccggcgccacggaggtggacagtggcgacggcaatcacatgtttgcggggcacctcaaatgcaaggtacgcatggagaagctccgcattaaaggcatgagctacacgatgtgtagtggaaagttcagcatagacaaggagatggcggaaacccagcatgggaccacggttgtgaaggtgaagtatgaaggggccggggccccctgtaaggtccccatagagatacgagacgtgaacaaggagaaggtggtcggccgcgtgatttccgccacacctttggccgaaaataccaacagcgttacaaacatcgaactagagccccctttcggggacagctacatcgtgattggggtgggcaacagcgcccttaccctgcattggtttcggaagggttcgagcatcgggaagatgttcgagtccacgtacagaggggccaaacgtatggccatcctgggcgagaccgcgtgggatttcggttcagtaggcggtctcttcacctccctcgggaaggccgtgcaccaggtgttcggctcggtttatacgacaatgttcgggggggtatcctggatgatacgcatcctgatcgggttcctcgtgctgtggatcggcaccaatagccgcaacacttccatggcgatgacttgcatcgctgtcggcggcatcacgctgtttctgggattcaccgttcaggcagatatgggctgcgttgtgtcttggtcaggacgagagctcaagtgcgggagtggaatattcgtcgtggataacgttcacacctggaccgagcagtacaagttccaacccgaatctcccgcccggctagcatccgccatcctgaacgcccacaaggacggtgtctgtgggatccgatcgacaacccggctcgaaaacgtgatgtggaagcagatcaccaacgagctgaactatgttctgtgggaagggggtcacgacttaaccgtggtcgccggcgacgtcaagggagtcctgactaaaggcaagcgcgcgctgacaccgcctgcgtccgacctcaagtatagttggaaaacctggggcaaagccaagatcttcacccccgaggctcgtaactccacattcttaatagacgggcccgacaccagcgagtgcccgaacgagcggcgggcttggaacagtttcgaagtggaggactatgggttcggtatgttcactacaaacatctggatgaagttccgcgaaggcagctccgaggtatgcgaccacagactgatgtctgcggccataaaggaccaaaaggctgttcatgccgatatggggtactggatcgaatccagcaagaatcagacctggcagattgagcgtgcgtcattgatcgaggtgaaaacctgtctgtggcccaagacccacaccctgtggagcaacggcgtactcgagtcccagatgcttatccccaagagctacgctggcccattctcccaacataattatcggcagggatacgcaacccagacggtcggcccttggcacctggggaaacttgagatagatttcggagagtgcccgggcaccaccgtgaccatccaggagaactgcgatcacagagggcccagcctgcgaacaactaccgcatccggcaaattggtgacccagtggtgctgccgatcctgcacgatgcctcccctcagattcttgggggaggacggctgctggtatgggatggagatccgtcctctatccgagaaggaagaaaatatggtcaagtcccaggtcaccgccggccagggcaccagcgagactttcagcatggggctcctctgcctgactctctttgtcgaggagtgcctgcgcagacgcgtgacccggaagcatatgatcctggcggtggtcatcaccctctgcgccataatccttggcggcctgacgtggatggacctcttacgggccctgataatgctcggtgacacaatgagcggccgcatcggtggccagacccacctggcgatcatggctgtattcaagatgagtcccgggtacgtgttaggcgtttttcttcgcaaactgacctcccgcgagaccgccttaatggtcatagggatggccatgacgaccactctgtctataccgcacgacctgatggagctgatcgatggcattagcctcggtctgatcctgctcaagatcgtgactcagtttgacaacacgcaggtcgggactctcgcgctgtccctcaccttcatccgcagcaccatgtccctggtgatggcctggcggacgatcatggcagtgctgttcgtcgtgaccctcatccccctgtgccggaccagctgcctgcagaaacagagccattgggtagagattaccgcgctcatcttaggcgcccaggccttacctgtctacttaatgacgctaatgaaaggggcttcccggcgttcctggcccctgaacgagggcatcatggcggtgggcctcgtgtcacttctcggctcagctctcctgaagaatgatgtcccgcttgcaggcccgatggtggccgggggcctgctgctggcagcgtacgtaatgtccgggagtagtgcagacctctcgctagaaaaggccgccaatgtccagtgggacgagatggctgacatcactggttcctcccccataattgaagtgaagcaggacgaggatgggtccttctcgatccgggacgtcgaggaaacaaacatgatcacacttctcgtaaaactggcgctaatcacagtgtccggcctctacccccttgcgatccccatcaccatgaccctgtggtacatgtggcaagtaaagacacagcgcagcggtgccctctgggacgtcccctctccagcagccacacagaaggcggccttaagcgagggggtgtacaggattatgcaacgcggactattcggtaagacgcaagtgggcgtggggatacacatggagggcgtgttccacaccatgtggcacgtgacccggggttccgtcatctgccacgagaccgggcgactagagccctcctgggcggatgtgagaaatgacatgatctcttacggcgggggctggagactgggagacaaatgggacaaggaggaggacgtgcaggtcctggcgatcgagccggggaagaaccccaaacacgttcagacgaaaccgggcctgttcaagacgcttacgggggagatcggtgctgtgaccttggacttcaagcccgggacttcggggtccccgataatcaaccgcaaaggcaaagtaatcggactctatggcaacggggttgtgacaaaaagcggtgactacgtctccgcgatcacccaggcagagcggatcggggagcccgactatgaggtggacgaggacatcttcaggaagaagaggttaaccataatggatcttcaccccggcgccggaaagacgaagcgaatcctcccatcaatcgtccgggaggccttgaaacgccgcctgcgtaccctgatcctcgcgcccacacgggtcgtagccgccgagatggaagaggccctgagagggttaccaatccggtaccagactcccgccgtgaagtccgagcacacgggacgcgagatcgttgacctcatgtgtcacgcgaccttcacgacccggctgcttagctctacgcgcgtgccgaactataaccttatcgtcatggacgaagcccacttcaccgacccctctagtgtagccgccaggggttacatctccacgcgagtggagatgggcgaggccgctgccatcttcatgacggccactccgcctggggccaccgacccattccctcagagcaattcccccatcgaggacatcgaacgtgagattccagagcgcagctggaataccgggttcgactggatcaccgactatcagggcaaaacggtctggttcgtgccgtccataaaggctgggaacgacatcgccaactgcctgcgcaagagcggcaaaaaggtcatacagctatcacgtaaaaccttcgacaccgagtaccccaagaccaaactcacggactgggactttgtcgtaaccaccgacatcagcgagatgggagctaacttcagagcagggagagtgattgacccccgaagatgtctgaagcccgtcatcctaacagacggaccggagcgcgtgatcctcgccggtcccatcccggtgacgcccgcgtcagccgcgcagcgtcgtggccggatcgggcgcaacccagcacaagaggatgaccaatacgtcttcagcggcgaccccctgaagaacgatgaggaccacgcacactggacagaggctaagatgctactcgacaatatctatactccggagggcattattccgaccctgtttggcccggagcgcgagaaaacgcaagcaattgacggcgagttccggctgcggggggagcagcgcaagacctttgtggagttaatgcggcgtggagacctgcccgtgtggctgtcgtataaggttgcaagcgccgggatttcctacaaggatcgggaatggtgtttcaccggtgaacgtaacaaccagatcctagaagagaatatggaggtcgagatctggaccagggagggtgagaaaaagaaactgcgccccaagtggctcgacgccagggtgtacgcggaccccatggcgctcaaggatttcaaagagtttgctagcggccgcaagtccattactctcgacatcctgaccgagatagcttccttgccgacgtacctgtccagccgcgcaaaattggcgctagacaatatcgtaatgctacacaccaccgaacggggggggcgcgcctaccagcacgctctgaacgagctccccgagagcctggaaactctgatgctcgtggctctgctgggtgcgatgaccgccgggatcttcctattcttcatgcagggcaaaggcatcggcaagctgtctatgggcctgatcactatcgcggtggccagtgggctcctgtgggtcgctgagattcagccccagtggatcgcggcctccataatcctggagttcttcctcatggtgctgctgatccctgagcctgaaaagcagcggacccctcaggacaatcagcttatctacgtgatcctgactatcctaaccatcataggccttatcgccgccaacgagatgggtctgatcgagaagaccaagaccgacttcggcttctatcaagttaagacggaaaccacaattttagacgtagacctccgcccggcaagcgcgtggacactttacgccgtagcaaccaccatcctgacaccaatgttgcgtcacaccatcgagaacacttccgcaaacctgagcttggccgcgatagccaaccaggccgccgtccttatggggctgggcaaaggatggccgctgcaccgcatggatctcggcgtgccacttctggccatgggttgctattcgcaggtcaaccccaccaccctcactgcgagcttagtcatgctcctcgtgcactacgcgataatcgggcccggcctccaggccaaggccacgcgagaggcccagaaacgcaccgctgccggcatcatgaaaaaccccacggtggacggcatcaccgttatcgacctagagcctatctcctacgacccaaagtttgaaaaacagctcggccaagtgatgctgctggttctctgtgccggacagctactactcatgagaacgacatgggccttttgcgaggtcctgactctggctacgggcccaattctcactctgtgggagggaaacccaggtaggttctggaacaccaccattgccgtgtcaacagccaacattttccgggggtcctacctggcaggggccggcctcgcgttcagcctaataaagaacgcccaaacgccccgtcgggggaccgggaccacaggggagaccctaggcgagaagtggaagcgccagctcaattccttagaccgtaaagaattcgaagaatacaagcgcagcggcatactggaggtcgaccggacggaggccaagtctgcccttaaggatgggagtaaaatcaagcacgccgtatcacgcggcagctccaagatccggtggatagttgagcgcgggatggtgaaacccaagggcaaggtcgtggacctggggtgcggcagaggcggatggagctactacatggctaccctaaagaatgtgaccgaggtcaagggctacaccaaggggggcccggggcatgaggagcccatacccatggcgacgtacggttggaatctcgtgaagttacatagcggcgtagacgtcttttacaaacccacagagcaggtggataccttgctttgtgacatcggggagtcgagctcgaacccgaccatcgaggaaggtcgcacgctacgcgtactgaaaatggtcgagccgtggctcagctccaaaccagaattttgcattaaggtcctgaacccctacatgcccaccgtgatcgaagagctggagaagctgcaacggaagcacgggggcaacctcgtccgctgccccctgagccgcaactctacacatgagatgtactgggtgagcggtgcatccgggaatatcgtcagctccgtcaacaccacgagcaagatgttgctcaatcgcttcactacccggcaccgtaaacccacctatgagaaagacgtggacctgggcgccgggacgcggtccgtcagcaccgaaaccgaaaagcccgacatgaccatcatcggccgccggctccaacgcttgcaggaggagcacaaggagacgtggcattacgaccaggagaatccgtaccggacctgggcataccacgggtcatatgaggccccctccaccggttccgccagttccatggtgaacggcgtggtcaagctgctgactaaaccctgggacgtcatcccgatggtcacgcagctcgcaatgaccgacacgacaccctttgggcagcaacgcgtctttaaggaaaaagtggatacgagaaccccccagccgaagccgggcacgcgcatggtgatgaccacgaccgccaactggctgtgggcgttactcgggaaaaaaaaaaacccccggctgtgcacccgcgaggaattcatttcgaaggtccggagcaatgccgctataggcgccgtgttccaggaggagcagggctggacctcagcaagcgaggcggttaacgactcgcgcttctgggagctcgtcgacaaggaacgggccctacaccaggaaggcaagtgcgagagctgcgtgtacaacatgatgggtaaaagggagaaaaagctgggagagtttgggcgcgcgaaggggtcgcgggcgatctggtacatgtggttgggcgcgcgcttcttggaattcgaggcgctagggttcctgaacgaggaccactggttcggtcgagagaacagttggtcaggcgttgaaggggaggggctgcaccgcctggggtatattctcgaggaaatcgacaagaaagacggggacctcatgtacgccgacgacaccgccgggtgggacactcggatcaccgaggacgacctacagaacgaggagctgattaccgaacaaatggccccccaccacaagatcctcgctaaggccatcttcaagttgacctaccagaataaggtggtgaaggtcctgcggcccacgccgcggggcgccgtcatggatatcattagccgaaaagaccagcggggctccggccaggtgggcacgtatgggttgaatactttcacaaacatggaggtgcagctcatccgccagatggaggcagaaggtgtcatcactcaggacgacatgcagaaccccaaaggcttaaaggagagagttgaaaagtggctccgcgagtgcggggtcgacaggctgaagcgcatggccatctcaggcgacgactgtgtagttaagccactagatgaacggttcggcacctcacttctgttcctgaacgacatgggcaaggtccgcaaggacataccacaatgggagccaagcaaagggtggaagaactggcaggaggtccccttctgtagccaccatttccataagatcttcatgaaagacggccggtcactcgttgtgccttgccgaaatcaggacgagctcattggccgggcgcgcatctcccaaggagcaggctggtccctgagagagaccgcctgcctggggaaggcctatgcgcaaatgtggtccctaatgtacttccaccgtcgcgatctacgtctcgccagcatggctatctgcagcgccgtccccactgagtggttcccaacatcacgcacaacctggagcatccatgcccaccaccaatggatgaccacggaggacatgttaaaagtgtggaacagggtgtggatcgaggataatcccaatatgatcgacaagacccctgtccactcctgggaagatataccatacctgggcaagcgtgaggacctatggtgcgggtcacttatcggcctgagcagccgtgcgacatgggcgaaaaatatccacactgccatcactcaggtgcgcaacctcatcggcaaagaggagtacgtggactacatgcccgttatgaagcggtacagcgcgcccagcgagtccgaaggggttctctag

SEQ ID NO: 26278 - RNA, 9867 nt, synthetic construct
  misc_feature 1..9867: note = derived and/or modified CDS sequence (opt11) from DENV-4__FJ882585__SS-prME
  source 1..9867: mol_type = other RNA
tctaccatcacgctcctctgccttatccccactgtgatggcattccacctgtcgacgcgcgacggcgagcctctcatgatagtcgctaagcacgagcgcgggcgcccgctgctgtttaaaacaacggagggaatcaacaagtgcaccctcatcgcgatggacctgggggagatgtgtgaggacaccgtcacctacaagtgtccgctgctagtgaatactgagcccgaggacatcgactgctggtgcaacctgacgagcacttgggtaatgtacggaacctgcacacagagtggggagcggcgtcgggagaagcgcagtgtggcccttacgccacactctggtatgggattagaaacccgggccgagacgtggatgagctccgagggggcctggaaacacgcgcagcgcgttgagagctggatcttgcggaaccccggcttcgcgctgctcgctggattcatggcctacatgatcggccagaccgggatccagcggacggttttcttcgtgctcatgatgctggtggctccgtcctacggcatgcgatgcgtcggcgtggggaacagggacttcgtggaaggcgtcagcgggggcgcgtgggtggacctcgtgctggagcacggcggttgtgtgaccaccatggcccaaggcaagcccaccctggacttcgaactcacgaaaaccactgcaaaggaggtggcattgttgcgaacttattgcatcgaggccttgatctccaacattacgaccgccacccgctgccccacccagggggagccatacctgaaagaagaacaggaccagcagtacatctgccgccgggacgtggtcgaccggggttgggggaacggctgtggtcttttcgggaagggcggcgtggtgacgtgcgccaagttcagctgctccggaaagatcaccgggaacctcgtacagatcgagaacctggagtacaccgtggtggtcacagtgcataacggcgacacgcacgccgtaggaaacgacaccagcaaccacggggtgacagcaaccatcacccccaggtccccgagcgtggaagtcaagttgccggactacggcgagctcaccctggactgtgagccacggtccggcatcgacttcaacgagatgatcctgatgaagatgaaaaagaaaacctggctcgtgcacaagcagtggttcctggacctgcccctcccctggactaccggggcagacacgagcgaagtgcactggaactacaaggaacgcatggttaccttcaaggtgccgcacgcgaagcggcaggacgtcactgtactgggatcccaggagggcgctatgcacagcgccctggccggcgctacagaggtggacagcggggacggcaatcacatgttcgcggggcacctcaagtgcaaggtcaggatggagaagctgcgaatcaagggaatgtcctacacgatgtgcagcggcaagttctccatcgacaaggagatggccgagactcagcatgggaccactgtcgtgaaggtgaagtacgagggcgctggggcaccctgtaaggtccccatcgagatccgtgacgtcaataaggagaaggtagtaggccgcgttatcagcgcgactccgctggcggagaacacaaactccgtgaccaacattgagctggagccaccctttggggatagctatattgtaatcggggtgggtaactccgcactgaccctgcactggttccggaaggggagttccatcggcaaaatgttcgagtcgacgtaccgcggggccaaacggatggccatattgggcgagaccgcttgggactttgggagcgtgggtgggctgtttacctccctcggtaaggccgtccaccaagtgtttggctcggtctacacaaccatgttcgggggcgtcagctggatgatccggatcctcatcgggtttctggtgttatggattggtaccaactcacggaacacgtcaatggccatgacctgcattgcagtgggcggcatcacgctgtttctcgggtttaccgtccaggcggacatggggtgcgtggtgtcctggagcggccgcgaactgaaatgcgggtccggcatcttcgtcgtggataatgtgcacacctggaccgaacagtacaaatttcaacccgagtctcccgcccggctggccagcgccatcctcaacgcccacaaagacggagtctgcgggatccgctcaacaacccggctggagaacgtgatgtggaagcaaattacaaacgagttaaattatgtgctctgggagggtggtcacgatctgactgtagtggccggagacgtgaagggcgtcctgacgaaggggaagcgtgcgcttacaccgcctgcctctgacttaaagtactcatggaagacctggggcaaggccaagattttcaccccggaggcccggaacagcacgttccttattgacgggcccgacacgtcagagtgcccgaacgagcggagagcatggaacagcttcgaagttgaagactacggctttgggatgttcacaacaaacatatggatgaaattccgtgaaggttccagcgaggtgtgcgaccatcggctcatgtccgcggccataaaggaccagaaggccgtccacgccgacatggggtactggatagagagctccaagaaccagacatggcaaatcgagcgtgcgagcctgatcgaggtcaagacctgcctgtggcccaagacgcacacgctctggtccaacggggtgctggagagccagatgcttatccccaagtcatatgccggcccgttcagccagcataactatcggcaagggtacgccacccagacagtaggtccctggcacctcgggaaactggagatcgatttcggcgaatgccccggtaccaccgttaccatccaggaaaactgcgaccaccgggggccctccctgaggactaccactgccagcgggaagctagtcacccagtggtgctgccggagctgcacgatgccgcctctgcgcttcctgggggaggacggctgctggtatgggatggagatccggcctctctccgagaaggaggagaacatggtcaagagtcaggtcacggccggccagggcacctccgagaccttcagcatgggcctgctgtgcctcaccctttttgttgaggagtgcctgcgccggcgcgtgacccgcaagcacatgatcctcgcggtagtcatcaccctctgcgcaaccatcctgggcggtctcacctggatggatctgctgcgcgccctaatcatgctgggcgacaccatgtccggccggatcgggggccagacccatctggccatcatggccgtgttcaagatgagtcccgggtacgttctcggagtcttcctgcgcaaacttacctcccgggagacggcgctcatggtgatcggcatggccatgaccacgactctcagcatcccgcacgatctgatggagttaatcgatggcattagcctaggtctcatcctcctgaagatcgtgacgcaatttgataacacccaggtcggcaccctggccctcagcctgaccttcatccgctccacgatgtcactggtaatggcatggcggacaatcatggccgtgttattcgtcgttacactgatacccctgtgccgtacctcatgtctccagaagcagagccattgggtggaaatcacggctcttatcctgggcgcacaagccctaccagtttacctgatgaccctgatgaagggggcctccagacgctcctggccactcaacgagggtatcatggcggtagggctagtctcactgttaggcagcgccctactgaagaacgacgtgccactcgccggccccatggtggccgggggcctgcttctcgcggcttatgtaatgtccggcagctccgccgacctgtccctggagaaggccgccaacgtgcagtgggacgagatggccgcgatcaccggctcatccccaatcatcgaagtgaaacaggatgaggatgggtccttcagcatccgagacgtcgaggaaaccaacatgatcaccctcttagtcaagctggcgctcatcaccgtgagcggcctgtatcccctagccatcccgataacaatgactttgtggtacatgtggcaggttaagacccagagatccggtgcgctgtgggatgtcccttcccccgccgctacgcaaaaggcagccctgtccgagggggtatatcggatcatgcagcgcggtttattcggaaagacccaagtgggcgtcgggattcacatggagggcgtgttccataccatgtggcacgtgacgcggggcagcgtcatctgtcacgaaacggggagactcgagcccagctgggcggacgttcgcaacgatatgatctcctacggcgggggatggcggctcggggacaagtgggataaagaagaggacgtgcaggtcctcgccatcgagccggggaagaaccctaagcacgtgcagacaaagcccggactgttcaagacgctgaccggggagatcggcgcagtaacgctcgatttcaagccgggcacctcaggaagccccatcatcaaccgcaagggtaaggtaatcggactgtatggcaacggggtagtgaccaagtccggcgactacgtgagcgcaatcactcaggcggagcggataggagagcccgactacgaggtggatgaggacatcttcaggaagaaaagactgacgatcatggacctccaccccggtgccggcaagactaaacgcatcttaccgtccatcgtgagagaagcgctgaagcgccgcctgaggaccctcatcctggcgcccacccgggtagtggccgccgaaatggaggaggccctgcgcgggctccccatacggtatcagacgcccgcggtgaaaagtgagcacaccggccgggagatcgttgacttgatgtgtcacgcgaccttcaccacgcggctgcttagttcgaccagagttcctaactacaacctgatcgttatggacgaggcccacttcaccgacccctcttccgttgccgcgcgtgggtacatcagcacccgcgtggagatgggcgaggcagccgccatcttcatgactgccacccctcccggggccaccgacccattcccccagtccaacagcccaatcgaggatatcgagcgggaaatcccagaacgctcctggaacaccggattcgattggatcacggactaccaaggcaagaccgtttggttcgtgccgagcatcaaggccgggaacgacatcgccaactgcctccgcaagtccggcaagaaggtcattcagctctcgcggaagaccttcgacaccgaataccccaagacgaaactcacagattgggacttcgtagtgaccaccgacatttccgagatgggagccaacttccgggccggccgggtgatcgacccccgacgttgcctgaagcctgtcatcctcacggatgggccggaacgcgtgatcctggcagggcccattcccgtgacccccgcctcagcggcccagcgccgcggccggatcgggcgcaacccggcccaagaggatgaccagtacgtcttctcaggagaccccctgaagaatgacgaggaccacgctcactggacggaggccaagatgctcctggacaacatctacacgccggaggggatcatcccaacgctgttcggaccagagcgggagaagacccaggccatcgacggcgagttccggctcagaggggaacaaaggaaaaccttcgttgaactgatgcggcgcggcgacctccccgtgtggctttcctacaaggtcgcgtccgccgggatatcatacaaggacagagaatggtgcttcaccggggagcgcaacaaccagatacttgaggagaacatggaggtggagatctggacacgggagggggagaagaaaaagctgcgccccaagtggcttgacgcacgggtgtatgccgaccccatggccttaaaggacttcaaggagttcgcctccggccgcaagagtacaaccttagacatcctcaccgaaattgcctcccttccgacctacctgagctcccgagcgaaactcgcgctggacaacatcgtcatgctgcacacgaccgaacggggagggcgagcgtaccagcatgctctcaacgagctgcctgagagcctggagacccttatgctggtggctctgctcggcgccatgaccgccgggatcttcttgtttttcatgcagggaaaggggatcggcaagctgagcatgggactgatcacgatcgctgtggcctccggccttttatgggtcgcggagatccagccccagtggatcgcagccagtatcatactcgagttcttcctgatggtgctgctcatcccggaaccagagaaacaacgcactccccaggataatcaacttatctacgtaatacttaccatcttaacgattatcggcctaatcgccgccaacgagatgggactgatcgagaaaaccaagactgacttcggattctaccaggtcaagaccgaaaccacgatcctggatgtggacctgcgccccgcatcggcatggaccctgtacgcggtggccactacaatcctaacgccgatgctgcggcatactatcgagaacaccagcgccaacctgtcactcgcggctatcgccaaccaggccgccgtcctgatggggctgggcaaggggtggcccctccaccgcatggacctgggggtgcccctgcttgcgatgggctgttacagtcaggttaaccccaccacgctgaccgcctccctcgtcatgctcctcgtgcattacgctattatcgggccggggctacaggccaaggcaacccgggaggcccagaagcgcaccgcagccggcattatgaaaaaccccactgttgacgggatcaccgttattgatctcgagcccattagctacgaccccaagtttgagaagcaactgggccaggtgatgcttctcgtgctgtgcgcagggcagttgctcctaatgcggaccacctgggcgttttgcgaggtcctgaccctggccaccggccctattctgacactatgggaggggaaccccggacgcttctggaacaccacaatcgctgtgtctaccgccaatatcttcaggggttcgtatctggctggggcgggcctggcattctcactgatcaagaacgcccagaccccacgccgggggaccggcaccacgggggaaaccctcggtgagaagtggaagcgccagcttaactcattagaccggaaggagttcgaggagtacaagcgctccggcatcctcgaggtggatagaactgaagccaagtccgccctgaaggacgggtccaagatcaagcacgcggtaagccgcggcagcagcaagatccggtggatcgtggaacgcgggatggtgaagcccaagggcaaggtagtggacctgggctgcggacgcggcgggtggtcatattacatggccaccctgaagaacgttacggaggtcaagggctacacaaaagggggcccggggcacgaagaacccatccctatggcaacctatggctggaacttagtaaagctgcactctggcgtggacgtcttctacaagcctaccgaacaggtggacacgctgctgtgcgacatcggggagagcagctcgaacccgaccatcgaggaggggcgaacgctgagagtactgaagatggtcgagccctggctgagttccaaaccagagttctgcatcaaggtgctaaacccgtacatgccgaccgtgatcgaggagcttgagaagctccagcggaagcatgggggcaacctcgtccgttgcccactgtcgcgaaatagcacgcacgagatgtactgggtgtctggagcatctgggaatatcgtcagttcagttaatacgacctctaagatgctgttgaaccgcttcaccacccggcaccgtaagccgacctacgagaaggacgtagacctgggcgcggggacgcgctcagtttccaccgagaccgagaagcccgatatgacaatcatcggacgcagactccaacgtctgcaggaggagcacaaggaaacatggcactacgaccaggaaaacccttaccgtacgtgggcctatcacgggtcatacgaagccccctccacggggtcggcctcttctatggttaacggcgtggttaagctgctcaccaagccctgggacgtgatacctatggttactcagctggccatgacagacacgaccccctttgggcagcagagggtcttcaaggaaaaggtggacacccggacaccccaacccaagccgggcacgcgaatggtcatgaccaccaccgctaactggctgtgggcactgcttggcaaaaagaaaaacccccggctgtgcacgaaggaggagttcatctccaaagtccgctctaacgccgccataggggctgtgttccaggaggaacaggggtggaccagcgcatccgaagccgtaaacgacagccgtttctgggagctcgttgacaaggagcgcgccctgcaccaggaaggcaagtgcgagtcctgcgtgtataatatgatgggaaagagagagaagaagttgggtgagttcgggcgcgccaaaggatctcgcgcgatctggtacatgtggctcggagcgcgtttcctcgagttcgaagctctggggttcctcaacgaggatcactggtttggccgcgagaactcctggagcggcgttgagggtgaagggttgcaccgactggggtatattctggaggagatcgacaagaaagacggagacttaatgtatgctgacgacaccgccggatgggacacgcgaatcacagaggacgatctgcagaacgaggagctcattacggagcagatggctccccaccataaaatactcgcgaaggccatcttcaagttaacctaccagaacaaggtcgtaaaggtgctccgacctaccccgaggggcgcggtcatggatatcatctcgcggaaagaccagcgcggcagcgggcaggttggcacgtacgggctgaacacgttcactaacatggaggtgcagcttatcaggcagatggaggccgagggcgtcattactcaagacgatatgcaaaaccccaaggggctcaaggagcgcgtggagaaatggctgcgagagtgtggggtggaccgcctgaagcggatggcgatctcgggggacgactgcgtagtgaagcctctcgatgagcgcttcgggaccagtctattattcttaaacgacatgggcaaggtccggaaggacattccccagtgggagccgagcaaggggtggaagaactggcaagaggtccccttttgctcgcaccatttccataagattttcatgaaggatggccgctccctggtggtaccctgccggaaccaggacgagctgatcggccgcgcgaggatcagtcagggggccggctggtccttgcgcgagactgcctgcctggggaaggcctacgcccagatgtggagcctcatgtatttccaccgccgggaccttcgcctggcctcgatggccatctgcagcgctgtacccaccgagtggttcccgacaagccggacaacgtggtccatccacgcccaccaccagtggatgactacagaagacatgctgaaggtgtggaaccgtgtgtggattgaggacaaccccaacatgacagacaagacgcccgtccactcatgggaggacatcccatacctcggcaaacgagaggacctatggtgcgggtccctgatcggcctttcttcccgcgcgacctgggccaagaacatccacaccgccataacgcaagtgcggaacctgattggcaaggaggagtacgtggactatatgccggttatgaagaggtactctgctccctccgagagcgagggggtgctgtga

SEQ ID NO: 26279 - RNA, 9867 nt, synthetic construct
  misc_feature 1..9867: note = derived and/or modified CDS sequence (opt11) from DENV-4__FJ882586__SS-prME
  source 1..9867: mol_type = other RNA
agcaccataaccctgctatgtctgataccgacggtgatggcattccacctgtcaacccgggacggggagccgctcatgattgtcgccaagcatgaacgcggccgacccttgctgttcaagaccaccgagggcattaacaagtgcactctcatcgccatggacttgggggagatgtgtgaggacacggtgacctataagtgtcccctgctcgtgaacaccgagcccgaggacattgattgctggtgcaacctgacgtcaacctgggtcatgtatggcacatgcactcagagcggggagcgacggcgggagaagcgcagcgtggcactgacaccgcactcgggcatgggcctcgaaacgcgggcagaaacctggatgagctccgagggggcctggaaacacgcccagcgggtcgaatcgtggattctgcgcaaccccggcttcgctctgctcgctgggttcatggcctacatgatcggtcagacgggtatccagcggacggtctttttcgtgttaatgatgctggtggcaccctcctacgggatgcggtgcgtcggcgtggggaacagagatttcgtggagggcgtcagtggaggggcgtgggtggacctcgttctggagcacggcgggtgcgtcaccaccatggcccaggggaagcccaccctcgacttcgagttaaccaaaacaacagctaaggaggtggcactgctgcggacctattgcatagaagcactcatctccaacatcacgacagccacacgctgcccgacccagggggaaccatatttgaaggaggagcaagaccagcagtacatctgtcggcgcgacgtggtcgacagaggctgggggaacggctgcggcctgtttggtaagggcggggtggtgacgtgcgccaagttcagctgctcgggcaagataaccgggaacttggtgcagatcgagaacttggagtacactgtggtagtcaccgtgcacaacggagacacgcatgccgtgggcaacgataccagcaaccacggggtgaccgcaaccatcacgcctcggtcccccagcgtggaggtcaagctgccggactacggcgagctcaccctggactgcgagccccggagcgggatcgacttcaatgagatgatcctgatgaagatgaaaaagaaaacctggcttgtgcacaagcagtggttcctcgatctgcccctcccttggacaactggagccgacacgagtgaggtgcactggaattataaggagagaatggtcacgttcaaagtgccgcacgcgaaacggcaagacgtgaccgtcctagggtcccaggaaggggcgatgcatagcgcgttagccggagccactgaggtcgacagcggggacggcaaccacatgtttgcagggcacctcaagtgcaaggtgcgcatggagaaactgcgcataaaaggtatgtcctacacgatgtgcagtggcaagttcagtattgacaaggagatggcagagacccagcacgggaccaccgtcgtgaaggtaaagtacgagggcgccggagcgccctgcaaggttcccatcgagattcgtgacgttaacaaggagaaggtggtcggccgcgtgatctccgccactcctctggcggagaacaccaattccgtcaccaacatcgagctcgaaccgcccttcggggactcctacatcgtcatcggcgtgggcaactccgccctcaccctacattggttccggaagggaagctccatcggcaagatgttcgaaagcacctaccgcggggcgaagagaatggccatcttaggcgagacagcgtgggacttcggatccgtgggcggattgtttacttctctggggaaggccgtgcaccaagtgttcggcagcgtgtataccacgatgttcgggggcgtttcctggatgatccgcatactgatcggctttctggtcctctggattggcaccaactcccgaaacacctctatggcgatgacctgcatcgcggtcggcgggattacacttttcctcgggttcaccgtccaggctgatatggggtgcgttgtgtcctggagtggccgcgagttgaagtgcggcagcggcatctttgtcgtagacaacgtgcacacttggaccgagcagtacaagttccagcccgaatctcccgcgcggctggctagcgctatcctcaacgcccacaaggatggcgtctgcgggattcgtagtacgacccggctggagaacgtgatgtggaagcaaatcaccaacgagctaaactatgtcttatgggaaggagggcatgacctaaccgtcgtggcgggcgacgtaaagggcgtcctcacgaaaggcaagcgcgcgttaacccctccagcgagcgacctgaagtactcctggaagacctggggaaaagccaagatctttacccccgaggctcggaacagcacgttcctgattgacgggcccgacacgtccgagtgccctaatgagagacgggcatggaactcctttgaggtagaggactacggcttcgggatgttcaccaccaacatctggatgaagtttcgcgagggctcctctgaggtgtgcgatcacaggttaatgtctgcggccatcaaagatcaaaaggccgttcacgcagacatgggctactggatcgagtcctccaagaaccagacatggcagatagaacgcgccagcctgatcgaggtaaagacctgcctgtggcccaagacccataccctctggtccaatggggtgctggagagccaaatgttaatccccaagtcctacgcggggcccttcagccaacataattatcggcagggctacgccacccagacggtcggcccatggcacctcggtaagttggaaatcgatttcggcgagtgccccggcaccaccgtgaccatccaggagaattgcgatcaccgcgggcccagtctgcgcacaaccacggccagcggcaaactcgtgacccaatggtgttgtcgctcatgcaccatgccgcccctgcgtttcctgggggaggacggctgctggtacggtatggagatccggccactgtctgagaaagaggagaatatggtcaagagccaggtgaccgccggccagggaacctccgaaaccttctcgatgggattattgtgtctcacgctatttgtcgaggaatgcctccgcagacgagtgacgcggaaacatatgatcctcgcggtggtaattaccctatgtgccataattctgggcgggctcacctggatggatctgctgcgcgctctcatcatgttaggcgacacgatgtctgggcggatcgggggccagacacacctggccatcatggccgtcttcaagatgagccccgggtacgtgctcggggtattcctgagaaagctgacctcccgggaaaccgcgttgatggtgatcgggatggccatgaccactacgctgtcgataccgcacgacctgatggagttgatcgacggcatctccctggggctgatactcctgaagatcgtgacccagttcgacaatacgcaggtcggaaccctggcactcagcctcaccttcatcagatccaccatgagcctggtaatggcatggcgtacgatcatggccgtactctttgtcgtaacccttatccccctctgccgcacatcctgcctccagaagcagagccactgggtagagataaccgcacttatccttggagctcaggccctccctgtgtatctgatgacgctgatgaagggggctagccggcgcagctggccgttaaacgaggggattatggcggtgggacttgtgtctctgcttgggagcgcacttctgaaaaacgatgtgccgttagccggccccatggtagcaggagggctgcttctggcggcgtacgttatgagtgggagcagcgccgacctctccctagagaaggccgccaacgtccagtgggatgagatggccgacatcaccggctcctcccccatcatagaggtgaagcaggacgaggacggtagcttctctatccgggacgtggaggaaacgaacatgatcacgctcttggtcaagctggccttgattacggtgagcggcttatatcccctggcaatcccgataaccatgactctatggtacatgtggcaggtcaaaacccagaggtccggcgccctgtgggacgtccccagtccagccgccacccagaaggccgcactgtccgagggtgtttaccggataatgcaacgcggattattcggtaagacacaggtgggtgtcggaatccacatggagggtgtgttccacacaatgtggcacgtgactcggggcagcgtcatttgccacgaaacaggtcgcctcgagccctcctgggccgatgtacgcaacgacatgatcagctacggcgggggctggcggctaggcgacaaatgggacaaggaagaagacgtccaggtcctcgctatcgagccgggtaaaaatcccaaacacgtgcagacgaagcccggactgttcaaaactctgaccggggaaataggcgccgtgacgctcgactttaagcctggaacgtctggcagccctattataaaccgcaaaggcaaggtcatagggctgtacgggaatggggtcgtaaccaagtccggagactacgtcagcgcgatcacccaggccgagagaattggggagcccgactacgaagtcgacgaggacatcttccgcaagaagcggctgaccatcatggatctccaccccggtgccggcaagacaaagaggatcctgccgagcatcgtccgggaagccctgaagcgccggctgcgaaccctcatcctggcgcccacccgcgtcgtggccgcagagatggaggaagcactgcgcggactcccgatccgataccagaccccagccgtaaagtcggagcacacgggtcgcgaaattgttgacctgatgtgtcacgcgactttcaccactagactgctctcctcgacacgggtgccgaactacaacctgatcgtgatggacgaggctcatttcaccgacccttcatctgtggccgcccgggggtacatttcaacccgcgtggaaatgggcgaggcggcggcaattttcatgaccgctacgcccccaggggctactgacccgtttccccagagtaacagtccgatcgaagatatcgagcgggagatcccagagcgctcctggaacaccggattcgactggatcaccgactatcagggcaagacggtctggttcgtgccgagcattaaggccgggaatgacatagcgaactgcctgcgcaagtccggcaagaaggtgatccagctcagccgcaaaaccttcgacaccgaataccccaagaccaaactgacggactgggatttcgttgtcaccactgacatctccgagatgggggccaatttccgcgccggcagggtcatcgacccccgccggtgcctgaagccggtcatcctcaccgacgggccggagcgtgtgatactggccggtcccatcccggtgacgcccgcgagcgccgcccagcggcgcggacggatagggcggaacccggcccaggaagacgaccagtatgtcttctctggtgaccccctcaagaacgacgaggaccacgctcattggaccgaggccaaaatgctcctagataacatttacacccccgagggcataatcccgacattattcggaccggagagggagaagacacaggcgatcgacggagagttccgcttaagaggggaacagcgtaagaccttcgtggagctcatgcggcgcggcgacctgcccgtatggctcagctataaggtggcatccgccggaatcagctacaaggaccgggaatggtgctttacaggggagcgcaacaaccagatcctggaggagaacatggaggtggagatctggacacgagagggggagaagaagaagttacgtcccaagtggctggacgccagggtgtacgcggaccctatggccctgaaggatttcaaggagtttgcctcgggccgaaagagcattaccctcgatatccttacggagatcgcatccttgccgacctacctgtctagcagagcaaagctcgcgctggacaacatcgtcatgctgcatactaccgagcgcggagggcgcgcttaccagcatgccctcaacgaactgcccgaatccctggagacgctcatgcttgtcgcgctgctcggcgcgatgacagccgggatcttcttgtttttcatgcagggcaaagggatcggcaaactgagcatgggcctcatcaccatcgccgtggcatccggtctcctgtgggtcgccgagatacagccccagtggatcgcggccagcatcattcttgagttctttctcatggtgctactcataccggagcccgagaagcagcggactccccaggacaaccagctgatctatgtgatcctgacgatcctcaccattattggcctgatcgctgccaatgagatgggactgattgaaaagaccaagaccgacttcggcttctaccaggtcaaaacggagaccaccatcctcgatgttgacctgagacccgcctccgcctggaccctgtacgccgtggcgacgacgatcctcacccctatgctgaggcacaccattgagaatacgagcgccaatctgtccctcgccgcgatcgccaaccaggctgccgtcctgatggggctgggcaaaggctggcccctccaccgcatggacttgggagtccccctgctggccatgggctgttacagtcaggtcaacccgaccaccctcaccgcgtcccttgtaatgctcctggtgcattacgcaataattgggcctggcctacaggcgaaggccacgagagaggcacagaagcgcaccgccgccggcatcatgaagaaccccaccgtggatgggatcactgttatcgacctcgagcccatcagctacgaccccaagtttgaaaagcagctgggccaggtgatgctgttggtgctgtgtgccgggcagctgctcctaatgaggacgacgtgggccttctgcgaggtcctgacgctcgcgaccggaccgatactgacactatgggaggggaatcccggccgtttctggaacaccacaatcgctgtatccactgcaaacatcttccgtggcagctacctcgccggggccggcctggcgttctccctgatcaagaacgcccagacgccgcgccggggaacaggcaccaccggggagaccctgggcgagaagtggaaacgccagctgaacagcctggaccggaaagagttcgaggagtacaaacgctccggcatcctcgaggtggatcggacggaggctaagtcggcattgaaggacgggagcaagatcaagcacgcagtcagccgcggatcgagcaaaatccggtggatcgtggagcgcgggatggtgaaacctaagggcaaggtcgtggatttagggtgcggccgcggagggtggtcttactacatggcgaccctcaagaatgtgaccgaggtcaagggctacaccaaaggagggccgggccacgaggagcccattcccatggccacctacggctggaacctggtgaaactgcacagcggcgtggacgtattctacaagcccacagaacaggtggatactctgctctgcgacatcggggagagcagcagcaacccgaccatcgaggagggcagaacactgagagtgctcaagatggtcgagccttggctgtcaagcaaaccagagttctgcattaaggtgctgaacccgtacatgccgaccgtaatagaggagctggaaaaactgcaacggaagcacgggggcaacctggtccgctgccccctgtcacggaacagcacccatgaaatgtactgggtatcaggtgcttccggaaatatcgtctccagcgtaaacaccacttcgaagatgcttttgaaccgctttaccacccggcaccgcaagccgacctacgagaaggatgtggatcttggcgccgggacacgatccgtatccaccgagaccgagaagcctgatatgaccataatcggaaggaggctccagcgcctgcaggaggagcacaaagagacgtggcactacgatcaggaaaacccgtacagaacctgggcgtaccacgggagctatgaggccccctctaccggtagcgctagctcaatggtgaacggcgtggtgaagctgctcaccaagccttgggacgtcatccccatggtgacgcagctggccatgacggacactacacccttcgggcagcagcgcgtctttaaggagaaggtggacacccggacgccccagcctaagccgggtacacgcatggtgatgaccacgacggccaactggctgtgggcgctcctggggaagaagaaaaatccccggttatgcacccgcgaggagttcatctccaaggtccggtccaacgcggcgatcggcgccgtgttccaggaggagcaagggtggacaagcgcctccgaggcggtgaacgacagccgcttctgggagctcgtagacaaggaacgagccctgcatcaagagggcaagtgcgagtcatgcgtatataacatgatggggaagcgcgagaagaaacttggagagttcggcagagccaaaggaagccgggctatatggtacatgtggctcggcgcgcgcttccttgagttcgaggcgctggggttcttgaacgaggatcattggttcggccgtgagaacagctggtccggcgtggagggggagggcctgcaccgcctggggtacatcctcgaagagatcgataagaaggacggcgacctgatgtatgccgatgacacggcgggctgggacacccgtattaccgaggacgatctgcagaacgaggagctaattaccgagcagatggccccgcatcataagatcctggcaaaggccatcttcaaactgacctatcagaacaaagtcgtcaaggtcctcagacccacaccgagaggggctgtcatggacatcatctctcgcaaggatcagcgggggagcgggcaagtaggcacgtacgggctgaatactttcaccaatatggaggtgcagctgatccgccaaatggaggcagaaggcgttataacacaggacgacatgcagaaccccaaaggtctcaaggagcgggtagagaagtggctgcgtgagtgtggtgtggatcggctgaaacgcatggccatctccggagatgactgcgtggtgaagcccctagacgagcggttcgggacttccttattattcctaaatgacatgggcaaggtgcgcaaagacatcccccagtgggagccgtccaaggggtggaaaaactggcaggaagtccccttctgctctcaccattttcacaagatcttcatgaaggacggacggtccctggtggtgccctgccgcaaccaggacgaactgataggtcgggcccgtatcagccagggtgccggctggtccctccgcgagacagcctgcttggggaaagcctacgcccagatgtggtcattgatgtactttcacaggcgcgaccttcggttggcgtccatggcaatctgctcggccgtccccactgagtggttcccgacgagccgaaccacctggtccattcacgcccatcaccagtggatgacaacagaggacatgctgaaagtgtggaaccgggtgtggattgaggataaccccaacatgatagacaagaccccggtgcattcttgggaagacatcccctatctcggcaagcgcgaggacctgtggtgcgggtccttaatcggcttgagctccagggctacctgggcgaagaacatccacactgccatcgcccaggtcagaaacctcattgggaaggaggagtacgtagattacatgcctgtcatgaagcgctatagtgcaccctccgagagcgaaggggttctatga

SEQ ID NO: 26280 - RNA, 9867 nt, synthetic construct
  misc_feature 1..9867: note = derived and/or modified CDS sequence (opt11) from DENV-4__JN819406__SS-prME
  source 1..9867: mol_type = other RNA
tcaaccatcaccctactctgtctgattccgacggtgatggcctttcacctttcgacccgcgacggggagcccctcatgatcgtggccaagcacgagcggggtcggcccctgctgttcaagaccaccgagggcatcaacaagtgtacgctcatcgcgatggacctgggggagatgtgcgaggacacggtcacctacaagtgccccctgctcgtgaacaccgaacccgaggatatcgactgctggtgcaacctgactagtacctgggttatgtacgggacctgcactcaatcgggggagcggcgccgggagaaacgctctgtggcgctgacgccgcactccggaatgggcctcgagacccgggccgagacctggatgagctctgagggagcctggaagcacgcgcagcgagtagagagctggatccttcggaatcccggtttcgcgctgttggccgggttcatggcctacatgattggccagacaggcatccagcgcacggtgtttttcgtgctgatgatgcttgttgccccctcatacggcatgcggtgtgtcggcgtaggtaatcgcgactttgtggagggtgtcagcgggggcgcctgggtggacctggtactggagcacggcggttgcgtcaccaccatggcccagggcaagcctacgctggacttcgagctcaccaagacgaccgccaaagaggtggctctgctgcggacgtactgcatcgaggccctcatctccaacatcacgaccgctactcgctgcccgacccaaggggagccgtaccttaaggaagagcaagaccagcagtacatctgccgcagagacgtggtagatcggggatgggggaacggctgcggcctgttcgggaaagggggtgtggtgacatgcgccaagtttagctgctccggcaagattaccgggaacctcgtccagatcgagaatctggagtacaccgtagtggtcaccgtccacaacggcgacacgcacgccgttggcaacgacaccagcaaccacggggtgacagccacgatcacgccgcggtcccccagcgtggaagtgaagctgccggattacggcgagctgaccctggactgcgaaccccggtccgggatcgatttcaacgagatgatactgatgaagatgaaaaagaaaacgtggctcgtccacaagcaatggttcttggacctgcccctcccctggaccaccggggccgacacgagcgaggtgcattggaattacaaagagcgcatggtcaccttcaaagtgccgcacgcgaagcggcaggacgtgaccgtcttgggctcccaggagggcgccatgcacagcgccctggcgggtgccaccgaggtggacagcggggacggcaatcacatgttcgctgggcacctcaagtgcaaggtgcgcatggagaagctgcgcattaagggcatgtcctacacgatgtgcagcggcaaattctccatcgacaaggagatggccgaaacccagcatggaaccaccgtcgtgaaggtgaagtatgagggcgcaggggccccctgtaaggtccccattgagattagagacgtgaacaaggagaaggtagtcggtcgagtgattagcgcgacgcccctggcggagaacaccaactccgtgaccaacatcgagctcgagccgcccttcggggacagctacatagttatcggcgtgggcaactcggccctgactctgcactggttccggaaggggagcagtatcggcaagatgtttgagagcacgtaccgcggggccaaacgcatggccatcttaggagagaccgcttgggacttcgggtccgtgggcggcctgttcaccagcctggggaaagccgttcaccaggtgttcggctccgtgtataccacgatgttcgggggtgttagctggatgatccgcatcctcatcgggttcctagtgctgtggatcggaaccaactcccggaacaccagcatggccatgacctgcatagccgtgggcgggatcacgctcttcctaggtttcacggtccaagctgatatgggttgtgtggtgtcctggagcgcgcgcgagctgaagtgcggatccgggatcttcgtcgtggataacgttcacacctggaccgaacaataccagtttcagcccgagagccccgcccggctggccagcgccatactcaacgcccacaaggacggagtgtgcggcatccgctccacgaccagactagagaacgtgatgtggaaacaaatcaccaacgagctgaactacgtcctctgggaaggcggacatgacctgaccgtcgtggcgggggacgtaaagggcgtcctgacgaaaggcaagcgggcactcacccctcccgccagcgacttaaagtactcctggaaaacttggggaaaggcaaagatcttcacccccgaggcccgcaacagcacgtttctcatcgatggccccgacaccagcgaatgtcccaacgagcggcgggcgtggaacagtttcgaggtggaggactacgggtttgggatgtttaccaccaacatctggatgaagttccgcgagggatcctctgaggtgtgtgaccatcggcttatgtctgccgcaattaaagaccaaaaggcagtccatgcggacatgggatactggattgagtcgtcaaagaatcagacgtggcagatcgaacgcgcatcgctgatagaggtgaagacctgcttatggcccaagacacataccctctggtcgaatggcgtactcgagagccaaatgctgatccccaaatcctacgccggcccgtttagccaacacaactatcgccagggctacgctacgcagacggtcgggccctggcacctcggcaaactggagatcgacttcggggagtgccccggcacaaccgtgaccatacaggagaactgcgaccaccgcggaccgtcgcttcgcacgaccaccgcctccggaaagttagtgacccagtggtgctgccggtcgtgtacgatgccacctctgcggttcctgggtgaggacgggtgctggtatggtatggagatccggcccctctccgagaaggaggagaacatggtcaagagccaggtcaccgcggggcagggcaccagtgagacctttagcatgggactgctgtgcctaacactattcgttgaagaatgcctgcgacgccgcgtgacccggaaacacatgatcctcgccgtggtaatcactttatgcgccataatcctcggcgggttaacgtggatggatctgttacgtgctctcatcatgctgggggacacgatgtcggggcggatcggcgggcagacccatttggccatcatggcggtgttcaagatgtctcccggctacgttctcggggtcttcctgcgcaagctgacttccagagaaactgcgctcatggtgatcggcatggccatgacgaccactctgagcatcccgcacgacctgatggagctcatcgacgggatctctctgggcttgatcctcctgaagatcgtgacccagttcgataatactcaggtcggcaccctggccttgagtctgactttcatccgctcgaccatgagccttgtgatggcctggcggacgatcatggcggtactgttcgtcgtgaccctgattccgctgtgccgaacttcctgcctgcagaagcagagccactgggtggagatcaccgccttgattctaggtgcccaggccctccctgtatatttaatgactcttatgaagggtgcatcccggcgctcttggcccttgaacgaggggataatggcagtgggtctggtgtccctactcgggagcgcactgctgaaaaacgatgtccctctcgccggccccatggtggccggcgggctactgctcgcggcgtacgtcatgtccggctcgagcgccgacctgagtctggagaaagctgccaacgtccagtgggatgagatggccgacatcaccgggtcgtcaccgatcatcgaggtgaagcaggacgaagacggcagcttctcgatcagggacgtcgaagagaccaatatgatcaccttactggtcaaactggccctcatcacggtgagcgggctgtatcccctcgcaataccgataaccatgaccctttggtacatgtggcaggtcaagacccagaggtccggcgctctgtgggacgtccccagccctgctgcgacccagaaggcagccttgtctgagggcgtgtacagaatcatgcagcgcggcctattcgggaagacccaggtaggggttggcatccacatggaaggggtgttccacaccatgtggcacgtaacccgggggtccgtgatctgccatgagacaggacgcttagagccatcctgggccgacgtacgcaacgacatgattagctacggtggcggctggcggttaggcgataaatgggacaaggaggaggacgtacaggtcctagctattgaaccgggcaaaaaccccaagcatgtgcagacgaagcctgggcttttcaagaccctgaccggtgagatcggagcggtcaccctagactttaagcccggcacgtctgggtcaccgatcatcaacaggaaaggcaaggtaatcggcctctacggcaatggcgtggtgaccaagtccggggattatgtctctgcaatcacccaggcggagcggattggcgagcccgactacgaagtggatgaagacatcttcaggaaaaagcggctgaccatcatggatctccatcccggggccggcaagaccaagcgcatcctgccgtccatcgtgcgggaggcgttgaagcgcagactgagaaccctcatcttggcccccaccagagtcgtggccgccgaaatggaggaggctctccgcggcctcccaatcagataccaaactcccgcggtcaagagcgaacacacggggcgcgagatcgtcgacctgatgtgccacgcgaccttcaccaccaggctgctttccagcacgcgcgttccgaactacaacctgatcgtcatggacgaggcacacttcaccgaccccagttccgtcgccgccaggggatacatctcgactcgcgtggagatgggggaggcggccgccatcttcatgacggccactcctcccggagccactgacccgttcccccagtccaacagccctatcgaggacatcgagcgggagatccccgagcgatcctggaacactgggttcgactggatcaccgattaccagggcaagacggtctggttcgtgccgtcgataaaggcgggaaacgatatagccaactgcctgcgcaaatccgggaagaaggttattcagctcagcagaaagaccttcgacaccgagtacccaaagactaaactgacggactgggacttcgtcgtgactactgacatttctgagatgggcgccaacttccgcgccggtcgggtgatcgacccccgccgatgccttaagcctgttatccttaccgacggcccggagcgagtgatactggctgggcccatccccgtgacgcccgcctccgccgctcaacggcgcggccggatcggccgcaatccggcccaagaagacgatcagtacgtcttctccggggaccccctaaagaacgatgaggaccatgctcactggaccgaggccaagatgctcctggacaacatctacacacccgaggggatcatccccacccttttcgggccggagcgggagaagacccaggccatcgacggcgagtttcgcctccgtggcgagcagagaaaaactttcgtggagctgatgagacgcggggacctgcccgtgtggctctcttacaaggtcgcctccgccggaatctcgtacaaggatagagagtggtgcttcacaggtgagcgcaacaaccagatcctggaggagaacatggaagtggaaatctggacccgggagggcgaaaagaagaagctgcgccccaagtggttggacgcgcgggtgtacgctgaccccatggctttgaaagacttcaaagagttcgcctccggtcgtaagagcatcacgctggacatcctaacggagatcgcctccctcccgacctacctgtcgtcccgcgcaaagctcgccctggacaacatcgtcatgctgcatacgaccgagcgtggcggccgcgcctaccagcacgcgctcaacgagttacccgagagcctggagacgctcatgctggtggcgttactcggggcaatgaccgccgggatcttcctgttttttatgcaggggaaggggatcgggaaactgtctatgggcctcatcaccatcgccgtagccagcggactgctgtgggtcgcggagattcagccccagtggatcgccgccagcatcatcctcgagttcttcctgatggtgctgttaatccctgaacccgagaaacagcggacgccccaagacaatcagctgatctacgttatcctgactatcctcaccatcatcgggcttatcgccgccaatgagatgggtttaatcgagaagacaaaaacagacttcgggttctaccaggtcaaaactgagacgacgatcctcgacgtggatctgcgccccgcatccgcatggacactgtacgccgttgccacgaccattctcacccctatgctgcggcacaccatcgagaacactagtgccaacctgtccctagcggctatcgccaaccaggccgccgtcctgatgggcttagggaagggctggcctctccaccgcatggacctgggcgtgcccctgctcgcgatgggctgctactcccaggtgaacccaacaaccttgaccgcctctctggtcatgctactggtacactacgccatcatcggcccggggctgcaggctaaagctacgcgagaggcccagaagagaaccgccgcaggcatcatgaaaaaccccactgtggacggcatcacagtaattgatctcgagcccatcagctacgaccccaagtttgagaaacaactgggccaagtgatgctgctcgtgctatgcgccggccaactactcctgatgagaacgacctgggcgttctgcgaggtcctgacgcttgccaccggcccgatactaacgctgtgggagggcaaccccgggcgcttctggaacaccaccatcgccgtgtccacagcgaacattttccggggaagctatctagccggcgcggggctggccttctctctgataaagaacgcgcagacgccccgccggggcaccgggaccaccggcgaaaccctcggggaaaagtggaaaaggcagctgaacagcctggacagaaaggagttcgaggaatacaagcgcagcggcatactcgaggtggaccggactgaggccaagagcgccctgaaggacggctccaagataaagcacgcggtcagcagaggtagcagcaagatacgctggatagtcgagcgcgggatggtgaagcccaaggggaaagtcgtggatctgggatgcggtcgcggcggatggtcctattacatggcaaccctcaagaacgtaaccgaggtcaaggggtacaccaagggcgggccggggcacgaggagcccatccccatggccacgtacgggtggaacctggtaaagctgcacagcggcgtggacgtgttctacaagccaacggagcaggtcgacaccctcctgtgcgacatcggtgagagctccagcaacccgaccattgaagagggaagaacgctgcgcgttctcaagatggtcgagccctggctgtccagcaagcccgagttctgcataaaggtgctgaacccctacatgccgaccgtgattgaggagctggaaaagctgcagagaaagcacggcggtaacctggtccgctgtcccctgtcacggaactctacacacgagatgtactgggtgtccggcgcctcgggtaacatcgtctccagtgtgaacaccacgtcaaagatgctcctgaatcgttttaccactcggcaccgtaagcccacctacgagaaggacgtggacctgggggcgggcacgcgctctgtctccaccgagaccgaaaagcccgacatgacgatcattggtagacggttgcagcgcctgcaggaggaacacaaggagacgtggcactacgaccaggagaacccgtaccggacctgggcctaccacggcagctacgaagcgccctccacaggaagcgcctccagcatggtgaacggggtggtcaaacttttgacaaagccctgggacgtgattccaatggtgacgcaactggccatgaccgacaccacgcccttcggccagcagcgcgtcttcaaggaaaaggtggacacgcggacgccccaacctaagccgggaactcgtatggtcatgaccacgaccgctaactggctctgggcgctcctggggaagaagaagaaccccagactgtgcactcgcgaggagttcatctccaaggttcggagcaacgctgctataggggcggtgttccaagaagagcagggctggacctcggcctccgaggcggtgaacgacagccgattctgggaactcgtcgataaggagcgggccctgcaccaggagggtaaatgcgagagttgtgtatataatatgatgggtaagcgcgagaagaagctgggcgagttcgggcgcgccaagggcagccgggccatatggtacatgtggctaggcgcgcggtttttagagttcgaagccttaggcttcctcaacgaggaccactggttcgggcgggagaactcctggagcggagtggagggcgaagggctgcaccgactaggctatatcctcgaggagatcgacaagaaggatggcgacctcatgtacgccgacgacaccgctggctgggacacccggatcaccgaagacgaccttcagaacgaggagctgatcaccgagcagatggcgccgcaccacaagattctagcaaaagccatcttcaagcttacctaccagaacaaagtcgtgaaggttctccgtcccactccgcggggtgccgtcatggacatcatctcccgcaaggatcaaaggggaagcggccaggtggggacctacggactgaacaccttcaccaacatggaagtgcaactgatccgtcagatggaggccgagggggtcatcacgcaggacgacatgcagaaccctaagggactcaaggaacgtgtggagaaatggctcagagagtgtggtgtcgaccggctgaagcgcatggctatctccggggacgactgcgtagtgaagccgctcgacgagcggttcggcacgagccttctcttcctcaacgacatgggtaaggtccgcaaggacatccctcagtgggagccgtcaaagggctggaagaactggcaagaggttcctttctgcagccaccatttccacaagatctttatgaaagatgggcggtccttagtggtgccctgccgcaatcaagatgagctgataggccgggcccgcatcagccagggcgcaggatggtccctccgcgagaccgcctgtctgggcaaagcctatgcgcaaatgtggagcctaatgtatttccacaggcgcgacttacgcctggcgtccatggctatatgcagcgccgtgcccacggagtggttcccgacgagtcggaccacctggagcatccacgcccaccaccagtggatgaccacggaagacatgctgaaggtgtggaaccgggtttggatcgaggacaaccccaacatgattgacaagacgccggtccactcctgggaagacatcccctatctcgggaagcgcgaggacctgtggtgcggctccctgatcgggctcagctccagggccacctgggcgaagaacatacacaccgccatcacccaagttcgcaacctgataggaaaggaggagtacgtggattacatgccagtcatgaagcggtacagcgccccctccgagagcgagggcgtgctgtga

SEQ ID NO: 26281 - RNA, 9867 nt, synthetic construct
  misc_feature 1..9867: note = derived and/or modified CDS sequence (opt11) from DENV-4__GQ199876__SS-prME
  source 1..9867: mol_type = other RNA
agcaccataaccttgctctgcctgattcccactgtgatggcctttcacctgtccacgcgcgacggcgagccgttgatgatcgtcgctaagcacgagcggggcagacccctgctgttcaagacgacggagggcatcaacaaatgcaccctcatcgccatggacctgggggagatgtgtgaagatacggtgacttataaatgccccctgctagtgaacaccgagcccgaggacatcgactgctggtgcaacttgacgtcgacctgggttatgtacggcacttgcacccagtccggggagcggcgccgcgagaagcgctcggtggccctgacgccccactccggcatgggcctggagacccgcgccgaaacctggatgagctcagagggggcctggaagcacgcccagcgcgtggagagctggatcctgcggaatcccgggttcgcgctgctcgccgggttcatggcctacatgattggccaaaccgggatccagcgcacggtcttcttcgtgctgatgatgctggtggccccatcctacgggatgcggtgcgttggcgtagggaaccgcgatttcgtggaaggcgtcagcgggggcgcgtgggtggacctagtactggaacacggagggtgcgtcacaacgatggctcagggcaaacccaccctggactttgagttgacgaagacaaccgctaaggaggtggccctgctaaggacctactgtatcgaggcgctcatttcaaacatcacgacggcgactcgctgcccgacccagggggagccctatcttaaggaagaacaggaccagcagtatatctgccggcgcgatgtcgtggaccgggggtggggtaacggctgcggcctgtttggtaaaggcggggtggtgacgtgcgctaagtttagctgctccggcaagatcaccggcaatctcgtccagatcgaaaatctggagtacactgtggttgtcaccgttcacaacggtgatacgcacgccgtcggtaacgacacgagcaaccacggggtgaccgccaccatcacgccacgcagtccgtcagtggaggtcaagctgccggactacggagagctgacattagattgcgagccccggtccggcatagactttaacgagatgatccttatgaagatgaaaaagaagacatggctcgtgcacaagcagtggttcctggacctgcccctcccctggaccactggcgccgacacgagtgaagtgcattggaattacaaggagcggatggtcaccttcaaggtgccgcacgcgaaacggcaggatgtgacagtcctgggttcacaggagggcgctatgcatagcgccctcgccggcgctaccgaggtcgattcgggggatggcaaccacatgttcgccgggcacctcaagtgcaaggtccgcatggagaagctgcgcatcaaaggaatgtcttacacgatgtgcagcggtaagttctccatcgacaaggagatggccgagacccagcacgggaccaccgtggtgaaagtgaaatacgagggcgcgggggcgccatgcaaagtgccgatcgagatccgggacgtgaacaaggaaaaggtaatcggccgggtcataagcgcgacgccgctggcggaaaacaccaactccgtgaccaatatcgagctcgagccgcccttcggcgacagctacatagtgatcggggtgggcaactctgccctgaccctgcattggttccggaagggaagctcgatcggcaagatgttcgagagcacgtaccgcggggcaaagcggatggccatcctcggcgaaactgcttgggacttcgggtcagtaggcggtctgttcacctctctgggtaaagcggtccaccaggtcttcggcagtgtgtacacaacgatgttcgggggagtgagctggatgattcggatcctcattgggtttttagtcctgtggatcggcacaaattctcgaaacaccagcatggccatgacctgcattgcagtagggggaattacactgttcctcggtttcaccgtgcaagccgatatggggtgtgtcgtttcctggagtggccgcgagctcaagtgcggatccgggatctttgtagtggataacgtgcacacctggacagaacagtacaagttccagccggaaagcccagcgaggctggccagcgccatactcaacgcgcacaaggacggcgtgtgcgggattcgctcgacgactagacttgagaatgtaatgtggaagcagattacaaacgaattaaattatgtactttgggaaggtggccacgacctgaccgtcgtcgcgggggatgtgaaaggcgtcctgacgaaggggaaaagagcgctaacaccgcccgccagcgacttaaaatattcctggaagacatggggaaaggctaagatcttcacgcctgaggcccggaactctacgttcctgatcgacgggcctgacacctccgagtgtccgaacgaacgccgggcctggaacagcttcgaggtcgaggactatggcttcggcatgttcactaccaacatctggatgaagttccgcgagggatcgagcgaggtgtgcgaccacaggctcatgagtgcagccatcaaagatcagaaagccgtacacgccgacatggggtattggatagagagctcgaagaaccagacgtggcagatagagcgagcgagcctgatcgaggtgaagacttgtctctggcccaagacccacaccctctggtccaacggcgtgctcgaatcacagatgctgatccccaagtcatacgctggccctttcagccagcataactatcggcaagggtatgcaacccagaccgtgggcccgtggcacctcgggaagctggagattgacttcggcgaatgccctgggaccaccgttaccatccaagagaactgcgatcatcgggggccatcactgcggacgaccactgccagcggcaagctcgtgacccaatggtgctgccgtagctgcacgatgccacccctgaggtttttaggggaagacgggtgctggtacgggatggagattagacccctcagcgaaaaggaggagaacatggtaaagagccaggtaaccgcgggccagggcacaagcgagacgtttagcatggggctgctgtgtttaaccctgttcgtggaggagtgcctgcgccggcgcgtcacccgaaagcatatgattctcgcagttgtgatcaccctgtgcgccatcatcttaggcgggttaacgtggatggacctgctgcgcgccctaatcatgctgggggacacgatgtccgggcggatcgggggtcaaacacaccttgccatcatggccgtcttcaaaatgagtcccgggtatgtccttggagtgttcctgcgcaaactgacttctcgagaaaccgcgctcatggtcatcggaatggctatgaccaccaccctgagcatcccacacgatctgatggaactcatagatggcatctcgcttggcctgatcctcctgaaaatcgttacccaattcgacaacacgcaagtggggaccttggccctcagcctgaccttcattcggtccacaatgagcctggtcatggcttggcgcacgataatggccgtgttattcgtagtgaccctgatccccctgtgcagaaccagctgtctccagaaacagtcgcattgggtcgagattacggcgctgatcctaggcgcccaggcgcttcctgtgtacctcatgacgctaatgaaaggagcatcccgccgcagctggcctctcaatgagggcattatggcggtcgggctggtgtccctgttaggcagcgccttactgaaaaacgacgtaccgctcgcgggcccaatggtggccggaggcctgctgctggccgcgtacgtaatgtctggaagctcagccgacctgtccctggagaaggctgccaatgttcagtgggacgagatggcggacatcaccggctcgtcacccatcattgaagtcaagcaggacgaggatgggagtttttccatccgggacgtagaagagacaaacatgataaccctattagtgaaacttgcgctcatcacagtcagcggcctgtatccgctcgcaatcccgatcaccatgaccctctggtacatgtggcaggttaaaactcaacgctctggcgccctgtgggatgttccgagccctgccgccacccaaaaggcggccctgtccgaaggcgtctacaggatcatgcagcggggtcttttcggcaagacacaggtgggcgtggggatccacatggagggtgtgttccacaccatgtggcatgtgacccgggggagcgtgatatgccacgagaccggacgcctggagccctcgtgggccgacgttcggaacgacatgattagctacggcgggggctggcgactgggagacaagtgggacaaggaggaggacgtgcaggtcctcgccatagaaccggggaaaaaccccaagcacgttcagacgaaacccggcctgttcaaaaccctgacaggagaaatcggcgccgtgaccctcgacttcaagcccgggacgtccggcagcccgatcattaaccgcaaaggcaaggtgattgggctatacggcaacggggtcgtcaccaagtccggcgactatgtaagcgccatcacccaggcagagcgcataggggagccagactacgaggtcgacgaggatatattcaggaagaagcggctaactatcatggatttacaccccggcgcaggaaagactaagcgtatcttgccgtccattgtgcgggaggccctcaagcgccggctgcgcacccttatcctggcgcctactcgggttgtggctgctgagatggaggaggccttgagagggttaccggtgcgttatcagacccccgccgtgaaaagcgagcatacaggtagagaaattgtcgacctgatgtgtcacgctacctttacaacgcggctgctttctagcacgcgcgtcccgaactacaacctgatcgtgatggacgaggcccacttcaccgaccccagctccgtagccgcccgcgggtacattagcacgagagttgaaatgggcgaggcagctgccatcttcatgaccgctacgccgcccggggccaccgacccgttcccccaaagtaacagtcccatagaggacatcgagcgagagatacccgagagatcctggaatacaggtttcgactggatcaccgactaccaaggcaagacggtttggttcgtgccgagcatcaaggccgggaacgacatcgcgaactgcttgcgcaaaagtgggaagaaagtcatccagctcagccggaagacctttgacaccgagtaccccaagacgaagctcacagactgggactttgtcgtgaccactgacatctccgagatgggtgccaacttccgagctggccgggtgattgacccacggagatgcctgaagccggtgatcctcaccgatggtcccgagcgcgtaatcctggcgggtcccatcccagtaacgcccgcgagcgccgcccagaggcgcggacggattgggcggaatccggctcaagaagatgatcagtatgtcttctccggcgaccccctgaagaacgacgaggaccacgcccactggaccgaagcgaagatgctcctagacaacatctacacgcccgagggtattatccccaccctgttcggacccgaacgggaaaagacgcaagccatcgatggagagttccgcttgcgcggggaacaacggaagacctttgtggagctaatgcggcgaggcgacctgcccgtctggctttcctataaggtcgcctccgccggcatctcgtacaaagatcgggaatggtgtttcaccggcgagcgaaacaaccagatcctggaggagaacatggaagtagagatatggacccgggagggcgagaagaagaaacttcgtcccaagtggctcgacgcccgggtgtacgcggatcccatggcactgaaggactttaaggagttcgcctccggtagaaagagcatcacgctggacatcttaacggagatcgcatcactgccgacctacctgagcagcagagccaagctcgcgttagacaacatagtgatgctgcataccaccgagcggggagggagagcctatcagcacgccttgaacgagctaccagagtcgttggagacgctcatgctggttgccctactcggagcgatgaccgccgggatattcctgttctttatgcagggcaaagggatcggcaagttgagtatgggcctcatcactatcgccgtagcctccgggctcctgtgggtggcggagatccagccacagtggatcgcggccagcatcattcttgagttcttcctgatggtgctgttaatcccggagcccgagaaacaacggacgccacaggataatcaactcatctatgtgatcctgacgatccttaccatcatcggcctgatcgcagccaatgagatggggctgatagagaagaccaaaacggactttgggttctatcaagtgaagacagagaccaccatacttgacgtggatctacgaccagcctcagcatggacactgtacgcggtagccacaacgattctcaccccgatgctgcgtcataccatcgaaaacacgagcgccaatctctcccttgccgcgattgccaatcaggccgccgtcctgatggggctggggaaaggatggcccctccatcgcatggacctgggagtgcctctgctcgccatgggctgctatagccaggtgaatcccaccaccttaaccgcgagcctcgtcatgctcctagttcattacgcaattatcgggccgggcctgcaggccaaagccacgcgggaggcgcaaaagcgtactgcagccggcatcatgaaaaacccgaccgtggatgggatcaccgtcatcgaccttgagcccatcagctacgatccaaagttcgagaagcagctgggccaagtcatgctactcgttctgtgcgctggacagctgctcttgatgcggacgacctgggctttctgcgaggtccttaccctcgcgacgggaccgatcctgacgctgtgggaggggaaccccgggcggttctggaacacaaccatcgccgtgagcaccgcgaacatcttccggggcagctatttagcgggggccgggctagcgttcagcctgattaaaaatgctcagacgccccgccgggggaccggcaccaccggggagacgcttggagagaagtggaagcggcaactgaatagcctggaccggaaagagtttgaggaatacaagcgctcagggatacttgaggtggacagaacggaagccaaaagcgccctcaaggatgggagtaaaatcaagcacgctgtctctcgcgggtcctcaaagatccggtggatcgtggagcgcgggatggtgaagcccaagggcaaggtcgtcgacctggggtgcggacgcggagggtggagttactacatggcgaccctcaagaacgtaaccgaggtcaagggctacacgaaagggggcccgggacatgaggagccgatacctatggctacgtacggctggaacctggtcaagttacactccggcgtggacgtcttctacaagcccaccgaacaggtggacacgctcctttgtgacatcggggaaagctcatccaacccgactatagaggagggccgtacgctgcgcgtcctcaagatggtcgaaccctggctgtcctccaagcccgagttctgcattaaagtgctaaacccctacatgccgactgtgatcgaggagctggaaaagctccagaggaagcacgggggcaacctcgtgcggtgtcctctgagtcggaacagcacacacgagatgtattgggtgtccggggcctccgggaatatcgtatccagcgtgaataccacgtccaagatgctcctgaatcgtttcaccactcggcaccgcaagcctacctacgagaaggacgtggatctcggggcaggaacgcggagcgtatccaccgagacagaaaagcccgacatgacaatcatcggccgccgactccagcgattacaggaggagcacaaggagacgtggcattacgaccaggagaacccgtaccgtacgtgggcataccacgggagttacgaggccccttccaccggcagtgctagttcaatggtgaatggggtggtcaagttgcttacgaagccatgggacgtaattcctatggtgacgcagctggctatgaccgacacaacgcccttcgggcagcagcgcgtcttcaaggagaaggtggacactaggacaccccagcccaagcctgggacccgcatggtcatgaccacgaccgccaattggctatgggccctcctggggaaaaagaagaatccccggctttgtaccagagaggagtttatctccaaagtccggagcaacgccgccatcggcgctgtgttccaggaagaacaggggtggaccagtgcctccgaagctgtgaacgacagcaggttttgggagctcgtagataaggagcgggcccttcaccaggaaggcaaatgtgagtcctgcgtgtataacatgatggggaagcgagagaagaagctcggagagtttggccgcgctaagggctctcgagccatctggtacatgtggctcggcgcacgattcctggagttcgaggcacttgggtttctgaacgaggaccactggtttggccgggagaactcctggagcggcgtcgaaggggaaggcctgcaccgcctggggtacatcctggaggagatcgataagaaggacggagacctgatgtacgccgacgatacggcaggctgggatacacggataacagaggatgacttgcagaacgaggagctcatcacagagcagatggctccccatcacaagatccttgcgaaagctattttcaagctgacctaccaaaacaaggtagtgaaggtgttgcgacccacgccaagaggggctgtaatggacatcatatcgcgcaaggatcagcggggcagcggacaggtgggcacgtacgggctgaacaccttcaccaacatggaggtgcagctgatccgccagatggaggccgagggcgtcataacgcaggatgacatgcagaatcctaagggactcaaagagcgagtggagaaatggctgagagagtgtggggtcgaccggctgaagaggatggctatatcaggcgacgactgtgtcgtgaaacccctagacgagagattcgggaccagtctgttatttctcaacgacatgggcaaggtgagaaaggatatcccccagtgggagccatctaaagggtggaagaactggcaggaggtccccttctgtagccatcactttcacaagatcttcatgaaagacggtcggtccttggtagtgccctgccgcaaccaggatgagctcattgggcgagccaggataagtcagggggccggctggtccctccgcgagaccgcctgtttggggaaggcctacgcccagatgtggtcgctcatgtacttccatcggagagatctccggctggcgtccatggccatatgtagcgcagtacccacagagtggttcccaacgagccgcaccacgtggtctatccacgcccaccatcaatggatgaccactgaagacatgttgaaggtgtggaaccgagtgtggatcgaggataatcccaatatgacagacaagacccccgtgcacagctgggaggacatcccctatctaggtaaacgcgaggacttgtggtgcggatcgctcatcggcctcagttctcgggccacgtgggccaagaacattcatactgccatcacacaggtgcgtaacctgataggtaaggaggaatacgtagattatatgccggtcatgaagcggtactccgctccctccgagagcgagggcgtcctgtga

SEQ ID NO: 26282 - RNA, 9867 nt, synthetic construct
  misc_feature 1..9867: note = derived and/or modified CDS sequence (opt11) from DENV-4__KP723482__SS-prME
  source 1..9867: mol_type = other RNA
agcaccatgaccctgctctgcctgatccccacggtaatggccttccacctgagtacccgggatggtgagccgttaatgatcgtggccaagcatgagcgggggcgccccctgctgttcaagacgactgaaggcatcaataagtgtacgctcatcgcaatggatctgggggagatgtgcgaagacaccgtgacctacaagtgtcccctcctcgttaacaccgaacccgaggacatcgactgctggtgtaacctaaccagcacctgggtgatgtacggaacctgtacccagtccggggagagacgccgggagaagaggtcggtggcactgacacctcactctggaatgggcctcgagacgcgtgccgagacttggatgagctccgagggggcttggaagcacgcccagcgcgttgagagctggatcctgagaaaccccggctttgcgctgttggcagggttcatggcctacatgatcggacagaccgggatacagcgaaccgtgttcttcgtgctgatgatgctcgtagccccctcctacggcatgagatgcgtaggcgtggggaatcgcgacttcgtggaaggcgtctctggtggcgcgtgggtggacctcgtgttggagcatggggggtgcgtcaccaccatggcgcaaggtaaacccaccctggacttcgagctcacaaaaaccacagccaaggaggtggccctgctgcggacctactgcatagaagcctccatcagcaacattacgaccgcgacccgctgccccacccagggggaaccctatctcaaggaggaacaagatcaacagtacatatgccgccgcgacgtagtggacagaggctggggtaacggctgtggcctgttcgggaagggcggggtcgtgacttgtgccaagtttctgtgctccggcaaaatcactgggaatctggtccaaatcgaaaatctggaatacaccgtggtggtcaccgtacacaacggcaacacacacgccgtcggcaatgacaccagcaatcacggggtaaccgccaccatcacgcccagatccccaagcgtggaggttaaactgcccgattacggcgaactcacgctggactgcgaaccccgctccggtatcgacttcaacgagatgatcctgatgaagatgaagaagaagacgtggttggtgcacaagcagtggtttctggacctgccccttccctggaccgccggcgcggataccagcgaggttcactggaactacaaggagcgcatggtcacgttcaaggtacctcatgcgaagcggcaggacgtgacggtcctgggttcccaagaaggcgcaatgcactccgccctggcaggcgcgaccgaggtggatagcggcgatggcaatcacatgttcgccgggcacctgaagtgtaaggtaaggatggaaaagctgcgcatcaagggaatgtcatatacaatgtgttccggcaagttctcgatcgacaaggagatggcggagacgcagcacgggaccaccgtcgtgaaggtgaagtacgagggagctggggctccctgtaaagtccccatagagatccgggacgttaataaggagaaggtggtaggcaggataatatcctccaccccgttcgcggagaacaccaacagcgtgacaaacatcgagctggaacctccctttggggattcctatatcgtaatcggcgtaggcgactccgccctcaccctgcactggttcagaaaggggtcctccatcggcaaaatgttcgagtccacctaccgcggggccaaaaggatggcaatcctgggagagacggcgtgggacttcggcagcgtgggtggccttttcacctccctggggaaggccgtgcatcaggttttcggcagtgtgtacaccacgatgttcggaggggtgtcgtggatgatccgcatcctaattgggttcttggtcctgtggatcggcacgaacagccgaaacacctccatggccatgacttgcatcgctgtgggcggcatcactctgttcctgggattcaccgtgcaggccgatatggggtgcgttgttagctggaacggcaaggaactcaagtgcggatccggaatctttgttgtcgacaacgttcatacctggactgagcagtacaagttccagccagagtcccccgcgcggctggcgagcgcaatcctgaacgcccacaaggacggagtgtgcgggatccggtcaaccacgagactcgaaaacgtcatgtggaagcaaattacaaacgaactaaactacgtgctatgggaaggcgggcatgacctcaccgtggtcgctggcgacgtgaaaggagtgctgaccaaggggaagcgggcgctgacccctcccgtgaatgacctcaagtatagctggaagacatgggggaaggccaagattttcacccccgaggcccgcaactccacctttctcatagatgggcccgacacgtctgaatgccctaacgagagaagagcctggaatttcttcgaagttgaggactacggctttgggatgtttaccactaacatttggatgaaatttcgggagggatccagcgaggtctgcgaccaccgccttatgtccgccgcgatcaaggaccagaaggccgtccacgccgacatgggatactggatagagtcctccaagaaccaaacttggcagatcgagaaggccagcctcatcgaggttaagacgtgcttatggccgaagactcacaccttatggtccaacggggtcctcgagtcacagatgctcataccccggtcctacgcgggaccgttcagccagcacaattatcgccagggctacgccacccagacagctggcccgtggcacctggggaagctcgagatcgactttggtgaatgccccggcacgacggtcacaatccaggaggactgcgaccaccggggtccgagtctgagaaccacgaccgcaagcggcaagctggtgacccaatggtgctgccgatcctgtactatgccgcccctccggttcttgggggaggacggctgttggtacgggatggagattcgcccgttatcggaaaaggaggaaaacatggtgaagagccaggtaacggccggccagggaacctcagagaccttcagcatgggtctcctgtgcctgactctcttcgtggaggagtgtctcagacgacgtgtcacgcgtaagcatatgatcctggcggtggtaatcaccttctgcgccatcatcctcggcggcctgacatggatggatctgctcagagtcctgataatgctaggtgacaccatgtccggtcgtataggaggtcagattcatctcgccatcatggccgtgttcaagatgtcacctgggtacgtactgggcgtattcctgcggaagttaacgagtcgtgaaaccgccctaatggtcatcggcatggcgatgacgaccgtgttcagcatcccgcatgacctgatggagctcatcgacggcatttccttgggcctgatcttactgaaaatcgtcactcacttcgacaacacgcaggtgggaactctggccctcagcctgaccttcatccgttcgacgacgcccctagtaatggcctggcgcacaattatggccgtcttcttcgtggtgacattaatccctctatgccggacgagctgcctgcagaagcagtcccactgggtcgagatcactgccttaatcctgggcgcgcaagccctgccagtgtaccttatgactctaatgaagggggcctctcgacggtcctggccgctgaacgagggcatcatggccgttggcctcgtaagcctactgggatccgcgctcctgaagaatgatgtgcccctggccggtcccatggtggcggggggcctcctgcttgccgcctacgtcatgagcgggtcgagcgctgacctttccctggaaaaggccgcaaacgtgcagtgggacgagatggcagatatcacgggctccagccctataatcgaggtgaagcaagatgaggacggcagttttagcatccgcgacgtcgaagagacgaatatgatcactctgctcgtaaagctggctctgatcactgtgagcggactctacccgctggcgatccccgtcactatggccctgtggtacgtgtggcaggttaaaacgcagcgaagcggcgcactctgggacgtaccctcccccagcgccacgcagaaggccactctgtccgagggggtatatcgcataatgcagcggggtttattcgggaagacccaggtgggcgtcggtatccacatggagggcgtgttccacactatgtggcatgtaacgcgcggcagcgtcatctgtcacgagacagggcggctcgagccgagctgggcggatgtgcggaacgacatgatctcctacggcgggggttggcgcctgggggacaagtgggacaaggaagaggacgtacaagttctggccattgaacccgggaaaaaccccaagcacgtgcagactaagcccggcctgtttaagaccctgactggagaaatcggcgccgtgactctcgatttcaagccgggtacctctggctcacccatcattaacaagaaggggaaagtcatcgggttatacggcaatggtgttgtaaccaagtctggggactacgtcagtgcaattacgcaggccgaacggatcggggagccagactacgaggtggacgaggatatcttccgcaagaagaggctcaccatcatggacctgcacccgggcgcgggcaagaccaagcgcatccttccctccatcgtgcgtgaggcactgaaacgcaggcttcgcaccctcatcctggcacccacacgggtagtggccgctgagatggaggaggccttaagaggtctgcccattcggtaccaaacacctgccgtcaagtcagaacacaccggtcgcgagatcgtcgacctaatgtgccacgccaccttcacaactcggctgctgtcctcaacccgcgtgcccaactacaatctcatcgtcatggatgaggcccacttcaccgacccctgctcggtggcggcccggggctacatctcgacgcgtgtcgagatgggtgaggccgccgcgatcttcatgaccgcgacgccccccgggagcatagaccctttcccccagtccaactctcccatcgaggacatagagcgggagatcccggagagatcctggaacactggctttgattggatcacggattaccagggcaagaccgtctggttcgttccaagcatcaaggcgggtaacgacattgccaactgcctgcgcaagtccggcaagcgcgttatccagctttcccgcaaaaccttcgataccgagtatccaaagacgaagttgaccgactgggacttcgtggttaccaccgacatatccgaaatgggtgccaacttcagggccggccgcgtgatcgacccccgacgctgtctgaagcccgtcatcctgacggacgggcccgagcgagtgatcttggctggacccattcctgtgacccccgccagcgctgctcagcgccgtggccgcatcggacggaaccccgcccaggaggatgaccagtacgtgttctccggagacccactgaagaacgacgaggaccacgcgcattggaccgaggccaagatgctgctagacaacatctatacacccgaggggatcatcccgacgctgttcggtcccgagcgcgagaaaacccaagccattgacggtgagttccgcctccgcggggaacagcgtaagaccttcgtggagctcatgagacgtggcgatctgcccgtgtggttaagctataaagtagcctcagccgggattagctataaggatcgcgagtggtgtttcaccggcgagaggaacaatcaaatcctagaggagaacatggaggtggagatctggacgcgcgagggggagaagaagaagctgcggcccaaatggctggacgcccgcgtgtacgctgacccgatggcgctcaaggacttcaaggagttcgcctccgggagaaagagcatcacgctagatatcttaaccgagatcgcgaccctccccacgtacctgtccagtaaagctaagctggctctggataacatcgtaatgcttcacactaccgagaaaggcgggcgcgcctatcagcatgccttgaacgaactcccagagtccctggagaccctcatgctcgtggccctgctgggcgccatgacggccggcatattcctgttcttcatgcagggcaagggcatcggcaagctgagcatgggcttgattgccatcgcggtggcctcagggctcctgtgggtcgcggaaatccagcctcagtggatcgctgcgagcatcatcctcgagttcttcctcatggtcctgctgataccggagcccgagaaacagcgaacgccccaggacaaccaactcatatacgtaatcctgaccatcctgaccatcataggcctcatagcggccaatgagatggggcttatcgaaaagactaaaactgacttcggcttctaccaggttaagccggaaacgacgatcctggatgtggaccttaggcccgccagcgcctggactctgtacgccgttgcgacgaccatcttgacccccatgcttcggcacaccatagaaaacacgtccgccaacctgagtttagccgccatcgccaatcaggccgccgtcctcatggggctgggcaagggctggccactgcatcggatggacctcggggtgccgttactggccatggggtgctactcccaagtaaaccccaccaccctcaccgccagcctcgtcatgctgctcgtccattacgccatcatcggacccggcctacaggcaaaggcaacacgcgaggcccagaagcggaccgctgcggggatcatgaagaaccccaccgtggacggtatcaccgtcatcgatttggagccgatttcgtacgaccccaagttcgaaaagcagctgggccaagtgatgctgctggtgttatgcgtcgggcagttgctgctcatgcgcacgacctgggccctgtgtgaagtactcaccctcgccaccggccccgtgatgaccctttgggaggggaaccccggtcggttctggaataccaccatcgccgtcagcacagccaacatattccgaggctcctatttagcaggagccggccttgccttcagcctgatcaagaacgcccaaacgccgaggcgcggcaccggcacgaccggggagacgctgggcgagaagtggaagagacagctcaactcactggacagaaaggagttcgaggagtacaagcggagcggcattctggaggtggatcgcactgaggccaagagcgcgctgcgggacgggaccaagatcaagtacgcagtgagtcgcggctccagcaagatccggtggattgtcgagcgcggcatgatcaagccgaaaggaaaagtggtagatctggggtgcggccggggcgggtggagctattatatggccaccctaaaaaacgtcaccgaggtgaaaggctacacgaagggcgggcccggccatgaggagcccatcccgatggccacctacgggtggaacctagtgaagctgcatagcggcgtagacgtgttctataagcccaccgagcaagtagacacactgttatgtgacataggggaatcttcgtcgaatcccaccatagaggagggtcgcaccttacgtgtcttaaagatggtggaaccatggctctcatctaagccggagttttgcatcaaggtgctaaacccctacatgccgactgtgatcgaagagcttgagaagctccagcggcgccacgggggctccctggtgcggtgccccctgagccgcaactccactcacgaaatgtactgggtcagcggagcctccgggaacatcgtgtcttcagtgaacacgatctcgaaaatgctgctcaacagattcacgacacggcaccggaaaccgacgtacgagaaggacgtcgacctgggtgcaggaacgcgttccgtctccactgagaccgaaaagcccgacatgaccgtgatcggccggcgtttacagcggctccgcgaggagcacaaagagacgtggcactacgatcaggaaaacccctaccggacctgggcctaccatgggagctatgaggcaccgagcacggggagtgccagctccatggtcaacggcgtagtgaaactgttaaccaagccttgggatgttatccccatggtaacccagctcgcgatgaccgacaccaccccctttggccagcagcgcgtgttcaaggagaaggtcgatactcggacaccgcagcccaagcccggcacccgtatgatcatgaccacgaccgccaattggctgtgggcattactcggaaagaagaagtccccacggctgtgcacaagggaagaattcatctccaaggtgcggagcaacgccgccataggcgcggtgttccaagaagaacaggggtggaccagcgccagcgaagccgtcaacgactcccgcttctgggagctcgtggacaaggagcgggccctacaccaggagggcaagtgcgagtcctgcgtgtacaatatgatgggaaaacgcgagaaaaaactaggggagttcggtagagctaagggttcccgggcgatatggtacatgtggctgggcgcccgctttctcgagtttgaggccctggggtttcttaacgaagaccactggttctcacgagagaactcgtggagcggggtcgagggggaggggctccaccgcctgggctacatcctggaagacatcgacaagaaggacggggatttgatatacgccgatgacacagccggctgggacacccggatcaccgaggatgacctgcttaatgaagaactcatcaccgagcagatggcaccacaccacaagactttggctaaggcgatcttcaagctgacctaccagaacaaagtggtgaaggttctccgacccactcccaagggcgccgtaatggacatcataagccggaaggaccagcgcggatccggccaggtgggaacctacggcttaaacacattcacgaacatggaagtccaactgatccggcagatggaagcggaaggcgtgatcactcaggacgacatgcaaaaccccaagggcctcaaagaacgcgttgagaagtggctaaaggaatgcggcgttgacaggctgaaacgcatggccatctccggggatgactgcgtagtaaagccgctcgacgagcgtttctctaccagcttgctgttcctcaacgatatgggcaaggttcgcaaggacattccccagtgggagccgtcgaaagggtggaagaactggcaggaggtgcctttctgcagccatcatttccacaaaatcttcatgaaggatggacggtccttagtagttccgtgtcgcaatcaggacgagctgatcgggcgggcacgcatcagccagggagccggctggtccctgcgggagaccgcttgcttagggaaggcttacgcccaaatgtggtcactgatgtacttccataggcgcgacctccgcctcgcctcgatggctatctgcagcgccgtgcccactgaatggtttcccacctcgcgcaccacctggtccatccacgctcaccaccagtggatgacgaccgaagacatgctgaaagtctggaatcgggtctggatcgaagataaccccaacatgacggacaagacgcctgtgcacagctgggaggatatcccctatctcggcaagcgggaagacctctggtgtgggtccttgatcggcttgagtagcagagccacgtgggctaagaacatccacacagccatcacccaggtgcgaaaccttatcggtaaggaagagtatgtcgactacatgcccgccatgaagcggtactcagcgcctttcgagtccgaaggcgttctgtga

SEQ ID NO: 26283 - RNA, 9867 nt, synthetic construct
  misc_feature 1..9867: note = derived and/or modified CDS sequence (opt11) from DENV-4__JN638570__SS-prME
  source 1..9867: mol_type = other RNA
tcaacgatcaccctattatgccttatccccacggtcatggccttccacctatcaacgcgagacggggaacccctaatgatagttgcaaaacacgaaaggggccgcccccttctgtttaaaaccacagaaggtattaacaaatgcactctgatcgctatggatctcggtgaaatgtgtgaagacacagtcacgtataaatgtcccctactcgtaaacaccgaaccggaagacatagattgctggtgcaacctcacatcagcatgggtaatgtatggtacctgcacccaaagcggggaacgcaggcgtgaaaagcggagcgtggcactcacaccccactcgggaatgggcctagaaacgcgagccgaaacgtggatgtcgtcagaaggagcctggaagcacgcacagcgggtcgaaagctggatcctgcgcaacccgggattcgcactcttagcgggatttatggcgtacatgatcggtcaaacagggattcaacgaacagttttctttatactcatgatgctagtcgcgccaagctacggcatgcgctgtgtaggcgttgggaatagggatttcgtcgaaggcgttagcgggggcgcttgggtagacctagtactagaacacggcgggtgcgtgaccacgatggcgcaaggtaaacccaccctggacttcgaattaatcaaaacgacagcaaaagaagtcgcactgctacgcacatactgcatcgaggcttcaatatccaacattaccactgcgacaagatgccccactcagggcgagccttacctcaaagaagaacaagaccagcaatacatctgtagacgggatatggttgatagaggctgggggaacggatgcggcctttttggcaaaggtggcgtagtaacgtgtgccaaattttcttgcctcgggaaaattacaggaaacctggtccaaatagagaacttagaatacacagtcgtcgtaaccgtacataacggtgacacgcatgcagtgggcaatgacacatccaaccatggggtcaccgcgacgatcacaccaaggtcccctagcgtagaggtgaaactgccagattacggcgagcttactctagactgcgagccccgatcagggatcgacttcaatgaaatgatactcatgaaaatgaaaacgaaaacgtggctcgtccataaacagtggttcctcgacctgccactaccgtggaccacaggggcggatacactagaagtacactggaaccacaaagagaggatggtaacgttcaaagtgccacacgccaagcgtcaagacgtcacagttctaggctctcaagaaggggccatgcacagtgctctcgcaggagcaacagaagtcgacagtggcgatggaaaccacatgttcgctgggcacctcaagtgcaaagtgcgcatggagaaacttcgcattaagggcatgagctacacaatgtgcagcggaaaattttcgatagataaagagatggcagagactcagcacggaacaaccgtagtaaaggtaaaatatgaaggaacaggagccccatgtaaggtgccaatagaaatccgggacgtcaacaaagaaaaggtcgtgggccgaatcatatctagcacacctttcgcagaaaacacaaacagtgtaacaaatattgaactagagccgccattcggcgatagctatatcgtaatcggcgttggcgacggcgccctgaccctgcattggtttaggaaaggctccagcatcggtaaaatgtttgagtccacctacagaggggctaaacgaatggccatactcggcgaaacagcctgggacttcggtagtgtgggaggactcctcacgagccttggaaaagccgtacaccaggtgtttggctctgtatacactaccatgttcggaggtgtctcctggatggtccgtatattaataggactgctcgtactatggatagggacaaacagccgtaacacaagcatggcaatgtcctgcatcgcggtcggcggcatcacactgttccttggcttcaccgttcacgcggacatgggctgcgtcgtatcctggagcggaaaggaactgaaatgtgggagcggaatatttgtaatcgacaacgttcatacatggacagaacaatacaagttccaaccagagtcccccgcccgcttggcgtccgcaatcctaaacgctcacaaagaaggcgtctgcggtattcgctcaacaacacggctagaaaacgttatgtggaaacagatcaccaacgaactaaactacgtcctatgggaaggcggtcacgacctaacagtagtcgccggcgacgtgaagggagtgctctcaaaaggcaagagagcgttagcaccacccgtaaacgacctaaaatactcttggaaaacgtgggggaaggcgaagattttcaccccagagaccaggaacagcacgttcttggtcgacggaccggacacatcagagtgcccgaatgagaggagagcatggaacttcctcgaagtcgaagactacggcttcggcatgttcacaaccaacatctggatgaaattcagagaagggagtcccgaagtatgtgaccacagactaatgtcagcggccatcaaagatcaaaaagccgtacatgcggacatgggctactggatagaaagtagcaaaaaccaaacctggcagatcgaaaaagcgtcactcatagaagtaaagacctgcctatggcccaaaactcacacactgtggtcgaatggagtactcgaaagccaaatgctgataccaaaggcatatgcgggaccaatatcacaacacaactacagacaaggatatgcaacccaaactgccggcccctggcatctcggaaagctagagatcgatttcggcgagtgcccaggtacgacagtcacagtacaagaagactgcgatcacagaggacccagtttgcgcacgactacagcaagtggcaaattagttacacaatggtgctgtcggtcttgcaccatgccaccgcttcgattcttaggcgaagatggatgctggtacgggatggaaatccgtcctctcaacgaaaaagaggagaacatggtcaaaagtcaggtcagcgccggacaagggacaagtgaaacgttcagcatgggactactatgccttacactttttgtcgaagaatgtcttagacggcgagtaacgcgcaaacacatgatgttggtagtagtaaccacgttgtgcgcaattatccttggtggtctgacgtggatggacctcctgagggcgctgattatgctcggagataccatgtcgggcagaatgggtggccaaattcatctggcaataatggctgtattcaagatgtccccgggctacgtgttaggaatattccttagaaaattaaccagcagagagacggctctgatggtgataggcatggcaatgacgacagtcctagccattccgcatgacctcatggagttcatcgacggaatctcgctgggcctaatccttctaaaaatggtgacacactttgacaatacacaagttgggacgcttgcactagcactgacattcataaaatcaacgatgccccttgtcatggcatggcgcacgataatggcagttctattcgtcgtaacactaatcccactctgccgcacgtcatgtctacagaaacagtcccactgggttgaaataactgcactcatcctaggggcccaagcactgccagtatacctgatgactctcatgaaaggcgcctcaaaaaggagttggccactgaacgaagggatcatggcagtcggactggtctcgctactgggtagtgccctactcaaaaacgacgtgccactggccggtcccatggtcgcgggcggcctgctgctcgcggcctacgtgatgtccggaagctcggccgacctctcgctggagaaggctgcaaacgtgaggtgggacgaaatggccgacattacggggagctcacccatcatcgaagtgaaacaagacgaagacggatccttttccatacgcgacgtagaagagacgaatatgatcacattgctggtaaagctagcacttataaccgtatcgggattataccccctagccataccagtcacgatgaccctctggtacatgtggcaagtgaaaactcagcgaagcggagcattgtgggacgtcccatcacccgccgcggcacaaaaagccacgctcacggaaggcgtctacaggattatgcaacgcggactatttggcaaaacacaagtgggcgttggaatccatacggaaggtgtcttccacaccatgtggcacgtaaccagaggtagcgtaatctgccacgagtcaggccggttggagccgtcatgggctgacgtgcggaatgacatgatttcttatggaggcggatggcgcctaggagacaagtgggacaaagaagaagacgtgcaagtgttagcaatagagccaggcaaaaacccaaagcatgttcaaacgaaacctggcctattcaaaaccctgaccggcgaaataggcgctgtaacactggattttaagcccggaacatccggatcaccaataataaatcgaaaaggaaaggtaatcggtctttacggcaacggggttgtcacgaaaagcggggattacgtctccgcaataacacaagcagaacggataggcgaaccggattacgaagttgacgaggacattttccgaaagaagagactgacgataatggaccttcacccaggggccggtaaaaccaaacgcattctaccatcaatagtaagagaagcactcaaaagacggttacgaacacttatactggcccccacaagagtagtagctgccgaaatggaggaagccctcagggggctacccatacgataccagacgccagctgtgaaatcagaacacaccggcagggagattgtcgatctaatgtgccacgccacattcacaacccgcctgcttagctcaacgagagtcccgaactacaacctgatcgtaatggacgaggcccattttacagaccctagctctgtagcggcgcgaggctatatttcaacgagagtggaaatgggcgaggctgccgcaatattcatgactgcgaccccgccgggtacgaccgaccctttccctcaaagcaatagccctattgaagatatcgagagagaaatccctgaacggagctggaacacgggtttcgactggatcactgactaccagggtaaaacggtatggttcgtcccctccataaaagcaggaaatgacatcgccaactgcctcaggaagagtggcaagaaagtaatacaactgagcagaaaaacctttgacaccgaataccccaaaacaaaactgacagattgggatttcgtcgtaaccacggacatatcagagatgggcgcgaacttcagagccggacgtgtgattgatccgcgaagatgcctaaaaccagtcatactgacagacgggcccgagagagtaatacttgctggaccgatcccggtaactcccgcctcagcagctcaacggagaggtcggatagggcgaaatcctgcccaagaggacgatcaatacgtcttcagcggggacccgctacgcaacgacgaagaccacgcacactggactgaagccaagatgttgctagacaatatttacacacctgaagggatcattcctaccctgttcgggccagaacgcgagaagacccaagcaatagacggggagttcaggctacggggagaacagcgcaagacgttcgttgaactgatgaggcggggagacttaccggtatggctcagttacaaggtggcgagcgcaggtattagctacaaagaccgagaatggtgcttcaccggtgaacgaaacaaccaaatcttagaagaaaatatggaagtagaaatctggacccgagagggggagaagaagaaactacgacccaaatggctagacgcccgcgtctacgcagatccaatggcattgaaagacttcaaggagtttgcgagcggacggaaatccataacactagacatattaacggaaatagcaagtcttcccacctacctctcttctagagccaaactagcgctggacaacatcgtgatgctccataccacagaaagaggagggaaagcctaccaacatgccctcaacgaactaccggaaagcctggaaacactcatgctggtcgcgctcctgggcgcaatgacagctggcatcttcctcttcttcatgcaagggaagggtataggcaagctatccatgggattaatcgccatcgcagtggcatcaggcctcctatgggtcgcggaaattcaaccgcagtggattgcagcgtcgatcatcctagagttctttcttatggtactactcgtcccagaacccgaaaaacaacgcacccctcaggataaccaactcatttacgtaatcttaacaattttgaccattattgcgctagtcgcggcgaacgagatgggcctaatcgagaaaacgaaaacggattttggcttttaccaagtaaaggccgagacaaccatacttgacgtagacctaagaccggctagcgcctggacactctacgctgtagccaccaccattctgacgccaatgcttaggcacacaatagaaaacacttccgccaacctctctctggccgccatcgcgaaccaagcggcagtgctaatgggactcggcaaaggctggccactacaccggatggacctcggggtacccctgctagcgatggggtgctattcacaggtcaacccaacaacactgactgcctccctcgtcatgctgctggtgcattacgcaataataggacccggactccaagccaaggcaacccgagaagcccagaaaaggacagctgcgggaattatgaagaaccccacagtagacggaataaccgtaattgacctggaaccaatttcatacgatcccaaattcgaaaaacaactgggtcaggtgatgctcctagtactctgcgctgggcagctacttttaatgcgtacgacctgggccttctgcgaggtactgacccttgcaaccgggccgatcctaacgctctgggaaggcaatcccggacggttttggaatacgacaatcgccgtgtccaccgcaaacatattccgtgggagctacctcgcaggggctggactagctttcagccttattaaaaatgcccaaacgccccgtcggggaacgggcacaacgggagaaacactgggagaaaaatggaaaagacaactaaacagtctcgaccggaaggagttcgaagaatacaagcggagcggcatactagaggtagacaggacggaagctaagtcagcgctaaaagacggctccaaaataaaatacgctgtctcacgtggcaccagtaagattcgctggattgttgagcggggaatggtgaaaccaaaggggaaagttgtagacttaggatgcggacgcggcggctggagttactacatggcgacactcaaaaacgtaactgaagtcaagggatacaccaaagggggccctggacacgaagaaccgatcccaatggcgacttatggatggaacctagtgaaactccattcaggcgtggacgtcttttacaaaccgacggaacaagtcgacacacttctatgtgacataggcgagtcaagcagcaaccccacgatcgaggaaggacgaactctcagagtactaaaaatggtcgaaccctggctgtccagcaaacccgagttctgcataaaagtactcaatccatatatgcccaccgtgatcgaagaattagagaagctacaacgacgttacggcggttccttagttcgatgcccattaagtcggaatagcacacacgaaatgtactgggtgtctggcgtgagtggcaacatagtatcctcggtcaacaccacatcaaaaatgcttctcaaccggttcacgacgcgacatcgtaaaccaacctatgaacgcgacgctgacctcggggccgggacgcgctcagtatcaactgaaaccgaaaaacccgatatgacgataataggaagacgccttcagcgcctccaagaagaacacaaagaaacctggcactacgaccatgaaaacccctacaggacctgggcttatcacggcagctacgaggccccatcaacgggatcggcatcatcaatggtaaacggagtggtaaaattactcacaaaaccctgggacgtagtacccatggtcacacagctggcaatgaccgacacaacccccttcggccaacaacgggtatttaaagaaaaggtcgacaccaggaccccgcagccaaaaccgggtacccgggttgtgatgacaactacggccaactggttatggacactcctgggacgcaagaaaaacccccgcttatgcacccgcgaagagttcatcagtaaggtgcgaagtaacgcagctatcggggctgtcttccaagaagaacaaggatggacgtcagcgtccgaggcggtcaatgatagcaggttctgggaattggtggacaaggagcgagctctacaccaggaagggaaatgcgaatcatgcgtctataacatgatggggaagagggagaaaaagttaggtgaatttggtagggcaaaaggttctcgagccatctggtacatgtggctcggagcgcggtttcttgagttcgaagccctcggcttcctaaatgaagaccattggtttggcagagagaacagctggagcggggtcgaaggtgaaggcctgcaccgtctcggttacatactggaagatatagataagaaagacggagatctcatctatgcagacgacacggcgggttgggatacacgcattaccgaggacgacctgctgaacgaggaactcataacagaacagatggcgccccaccacaagatacttgcaaaagcaattttcaaactcacataccaaaacaaagtagtcaaggtattacggccgacaccaaagggagcagtgatggacatcatctcccgcaaagaccagcgagggagcggccaagtgggcacgtatggattaaacaccttcacaaacatggaagtgcagttgatccgccaaatggaggcagaaggggtgatcaccagagacgatatgcacaaccccaaaggcctcaaagaaagagtcgagaagtggctgaaggaatgtggggtagaccggctaaagcgaatggcaatatctggagacgactgcgtggtcaaaccactagacgagcggtttagcacttcactgcttttcctcaacgacatgggcaaggtacgaaaagacataccacaatgggaaccctctaaaggatggaagaattggcaggaggtcccgttctgttcccaccacttccacaagattttcatgaaagatggccggtcccttgtggtgccttgtcgaaatcaagatgagcttatcggccgcgcacgaatatcccaaggcgcgggatggtccctccgcgaaacagcctgtctcggaaaagcctacgcccagatgtggtctctcatgtacttccaccgtagagatctacgcctcgcctccatggcaatctgcagtgccgtgccgacagagtggttccccacatcgcgtaccacgtggtctattcatgcacatcaccagtggatgacaaccgaagatatgctaaaggtatggaacagggtatggatagaggacaacccgaacatgatagacaagactcccgtccactcatgggaagacatcccatacctaggtaaacgagaagacttgtggtgcggctccctaatcggcctgtcgagtagagccacgtgggcgaaaaacatccatactgcaatcacccaggtacggaacctcatcgggaaagaagaatatgtagattacatgccagcgatgcgcagatatagcgcccattttgaatcagagggcgttctgtaa

SEQ ID NO: 26284 - RNA, 9867 nt, synthetic construct
  misc_feature 1..9867: note = derived and/or modified CDS sequence (opt11) from DENV-4__JN638571__SS-prME
  source 1..9867: mol_type = other RNA
agcaccatcaccctcctctgtctgatacccaccgtgatggcattccacctgtccacccgcgatggcgagccgctcatgatagtggccaagcacgagcgggggcgcccactgctgttcaagaccaccgaaggcatcaacaagtgcaccttgatcgccatggatctgggcgagatgtgcgaggacaccgtgacttacaagtgccccctgctcgtgaacaccgagcctgaggacatcgattgctggtgcaatctgacctcggcctgggtcatgtacgggacctgcacacagtcgggtgagaggcgtcgcgagaagcggagcgtagccctgaccccgcactccgggatgggcctcgagacacgggccgagacctggatgagctcagagggggcgtggaagcacgcacagcgcgtggagagctggatcctgcgaaatcccggcttcgcgcttctcgccgggttcatggcctacatgatcggccagaccgggatccagagaacagttttttttatcctcatgatgctggtcgcgccctcctatggcatgcggtgcgtaggcgtcgggaaccgcgacttcgtagagggggtgagcggtggggcgtgggtggacctggtgctggagcacggcgggtgcgtgacgaccatggcccagggcaagccgaccctagacttcgagctcataaagaccacggcaaaggaggtcgccctactaagaacctactgcatcgaggcgtccatctctaacatcacgaccgccacgcgctgtccgacccagggggaaccgtatctcaaggaggaacaggaccagcagtacatctgccgacgggacatggtggaccggggctgggggaacggctgtggcctcttcggtaaggggggggtggtaacctgtgccaagttctcatgcctgggcaagatcacggggaaccttgttcaaattgaaaacctagagtatacagtggtcgtgaccgtgcacaacggcgacacccacgccgtcggcaacgacaccagcaaccacggggtgacagccaccataacgccaaggtccccctcggtagaagtgaagctgccggaatacggcgaactcaccctggactgcgagccccggtccgggattgacttcaacgagatgatcctgatgaagatgaagacgaagacctggcttgtacacaagcagtggttcctggacctaccgctcccatggaccactggcgctgacacgttggaggtacactggaaccacaaggaaaggatggtcacgttcaaagtcccgcacgccaagagacaggacgttaccgtgttgggtagccaggagggggctatgcactcagcactagctggcgcgaccgaggtcgacagcggcgacggcaaccacatgtttgcaggacacctgaagtgcaaggtgcgcatggagaaattgagaatcaaaggcatgagttacacgatgtgctcgggaaaattcagcatcgataaggagatggccgagacgcagcacggaaccactgtagtgaaggtcaagtacgagggcaccggggcaccctgcaaggtgccaatcgagatccgggatgtcaacaaggagaaggtcgtgggccgcataatctcctccacccccttcgccgagaacacgaattctgtgaccaacatcgaactcgagccgcccttcggagacagttacatcgttattggggtgggcgatggggcgcttaccctgcactggttccgtaagggcagttctatcgggaagatgtttgagtccacttaccgtggcgcgaagcggatggccatcttaggagagaccgcatgggacttcggcagcgtcggcgggttactgacctccctcggaaaggcggtccaccaagtgttcggcagcgtttatacgacgatgttcggcggggtctcctggatggttcgcatcctgatcggcttactggtgctttggatcggcaccaacagtcggaacacctccatggccatgagttgcatcgcggtgggtggcattaccctgttcctggggttcacggtacacgccgatatgggctgcgtggtttcctggagcggcaaggaactcaagtgcggctccggcatcttcgtgatcgacaatgtacacacctggaccgaacagtacaagttccagcccgaaagcccagcaaggctagcgagcgccattcttaacgctcataaggagggggtctgcggcatacgatccactactaggctcgagaacgtgatgtggaagcagatcaccaacgaactcaactatgtgctttgggagggcgggcacgacctcaccgtcgtggcgggcgatgtgaaaggagtactgagcaagggcaagcgggcgctggcaccgcccgttaatgacctcaagtacagctggaagacctggggaaaggccaaaatcttcacgccggagaccaggaatagcacattcctggtggacggccccgacacctccgagtgtccgaacgagcggcgcgcctggaactttctggaggttgaggactacgggttcggcatgttcacgaccaacatctggatgaaattccgggagggttcatctgaagtgtgcgaccaccgcctcatgagcgccgccatcaaggaccagaaggcggtgcacgccgacatggggtactggattgaatcgtctaaaaaccagacatggcagatagagaaagcctccctgatcgaagtcaagacttgtctgtggcccaagacgcacaccctctggtccaacggcgtgttggagtcccagatgctgatccctaaggcctacgcggggccaatctcgcagcacaactaccgtcagggctacgccacccagaccgccgggccctggcacctcggcaaactggagatcgacttcggagagtgccccggaaccacggtgaccgtccaagaggactgcgatcaccgcggcccctccctacggaccaccacggctagtgggaagctcgtgactcagtggtgttgccgctcctgcaccatgccgcctctgcgcttcctgggagaggatggctgttggtacggtatggaaatccggccactcaatgagaaggaggagaacatggtgaagtcgcaggtcagcgccggccaggggacctcggagacgttctcaatgggactgttgtgtttgaccctattcgtggaggaatgcttaagacggcgagtcacccggaagcacatgatgctagtggtggtcaccacgctgtgcgcgatcatcctcgggggcttgacctggatggacctgttacgcgccttgatcatgttgggcgataccatgtcggggcggatgggcgggcagatccaccttgccataatggccgtgttcaaaatgtcccccggctacgtcttaggtatcttccttcgcaagctgacctcccgggaaaccgccctcatggtcatcggtatggctatgaccacagtgctggccatccctcacgacctgatggagttcatcgacggcatctcactcggactgatcttgctcaaaatggtgacacattttgacaacacgcaggtcggcaccttggccctggccctcacctttatcaagtccaccatgcccctggtgatggcctggcgtacgataatggcggtgctgttcgtcgtgaccctcatacccctgtgtcggaccagctgcctgcagaaacagtcccactgggtggaaatcaccgccctcatccttggtgcccaggcgctgcccgtctacttgatgacgctaatgaagggcgcgagcaagcgctcctggccgcttaacgaggggattatggccgtgggcctagtgtcactgctgggcagcgccctcctgaagaacgacgttcctctggctggaccgatggtggcggggggtctcctgttagctgcatacgtcatgtctggctcaagcgctgacctctccctggagaaggccgccaacgtccggtgggatgaaatggcggacatcaccgggagctcccccatcatcgaagtgaagcaagacgaggacggcagcttcagcatacgcgacgtggaggagaccaacatgattacgctgctggtcaaactggcactgataaccgtgtccggcttatatcctctggccatcccagtgacaatgaccttgtggtacatgtggcaggtgaagacccagcggagcggggccctctgggacgtcccctcccccgccgccgcccaaaaggctacgctaaccgagggcgtgtatcgcatcatgcaacgggggctgttcggaaagacccaggtcggggtggggatccacaccgaaggcgtatttcacactatgtggcacgtaacgcgcggctcagttatctgccacgaaagcggccggttagagcctagctgggcagatgttaggaacgacatgatctcctatggtggcggctggcggctgggggataagtgggacaaggaggaggacgtccaggtgctggcgatcgagcccggcaagaacccgaagcacgtgcagaccaagcccgggttattcaagaccttaaccggcgagatcggggcggtaacgctggacttcaagcccggcacgtcaggctcccccatcatcaaccgcaaggggaaggttataggcctctacgggaacggcgtggtcactaagagcggggactacgtttccgccatcactcaggccgagcgtatcggcgagccggactacgaagtcgatgaggatatcttccggaagaagcgcctgacgatcatggatctgcacccgggcgcagggaagacaaagcggatcctgcccagcatcgtccgcgaggcgctgaaaagacgcctgagaaccctgatcctagcccccaccagagttgtggccgccgagatggaggaggccttacgtggcttgcccatccgctatcaaacgccggcggtcaagtccgaacacaccggacgtgaaatagtggacctcatgtgccacgccacgtttaccacgcgactgttgtctagtacccgggtgcccaactacaatctcattgtaatggacgaggcacacttcaccgacccgtcatccgtggccgcccggggctacatctctacacgggtcgaaatgggggaggccgcggccatcttcatgacggccacgccaccgggcaccacagatccctttccccagtccaactcgcccatcgaggacattgagcgcgagatcccggagcggtcttggaacacgggttttgactggatcaccgattatcaagggaagaccgtatggttcgtacccagtatcaaggccggcaacgacatcgcaaactgcctgcgcaagagcggcaagaaggtgatccagctgtcccgaaaaaccttcgacacggaatacccgaaaacaaagctcactgactgggacttcgtggtgaccacggacatctccgagatgggggccaacttccgcgccgggagggtcattgacccccggcgctgcctgaagccggtgatccttaccgacggcccagagcgggtgattctagctggccccattccagtcaccccagcttccgccgcccagcggcgcgggcgcattggcaggaaccccgcccaagaggacgaccagtacgtgttctctggcgaccccctgcgcaacgacgaagatcacgcccactggacggaggcgaaaatgctgctcgacaatatatacacacccgaaggcatcatcccgaccctgttcggccctgagcgggagaagacccaggctatcgatggtgagtttaggctgcggggagagcagcgtaagacctttgtggagctcatgcgtcggggtgacctccccgtctggctgtcctacaaggtggccagcgccggcatcagttacaaggaccgggagtggtgctttacgggggagcgcaacaaccaaatcctggaggagaacatggaagtggagatctggacgcgggagggtgagaagaagaagctgaggccgaagtggctggacgcccgggtgtacgcggacccgatggccctcaaagactttaaggagttcgcctccggccgcaagtccattaccctggacatcctgaccgagatcgccagccttcccacctacctgagttctcgggccaagctggcgctcgacaacattgtgatgcttcacacgaccgagcgcggagggaaggcctaccagcacgcactgaacgagctccccgagtccctggagaccctgatgctcgtggccttactgggggcaatgaccgcagggatcttcctctttttcatgcaggggaagggcataggcaagctgagcatggggttgatcgcaattgccgtagccagcggcctcttgtgggtggcggagattcaaccgcagtggatagccgcgagcattatcctggagtttttccttatggtgctcctggtccccgagcccgagaagcagcgcacgccccaggataaccagctcatctacgtgatcctgaccatcctgaccatcattgccctcgtggccgctaacgagatgggtcttatagagaagacgaagacggacttcgggttctatcaggtcaaggctgaaaccacaatcctggacgtggaccttcggccggcctcggcctggaccttatacgccgtggcgaccaccatcctaacgcccatgctccgccacaccatagaaaacacgtctgccaacctgtctttagcagccatcgcaaaccaggcggccgtcctcatgggcttggggaaaggatggcccctgcaccggatggacctgggggtgccccttctggcgatgggctgctactcacaggtgaacccgaccaccctcaccgcaagcttggtaatgctgctcgtgcactacgcgatcatcgggccaggcctccaggccaaggccacgcgcgaagcccaaaagcggaccgccgccggtatcatgaaaaacccaaccgtcgacggtatcaccgttatcgacctggaacccatcagttatgacccgaagtttgaaaagcagctcggccaggtgatgctactagtgctctgtgccggccagctgttgctcatgcgcacgacctgggccttctgcgaggtcctaaccctggccaccggccccatcctcacgctgtgggaaggaaaccccggcagattctggaacaccaccatcgctgtgagcaccgcgaatatcttcaggggctcctacctagccggggccggcctcgccttcagccttatcaagaacgcccagactccccgacgcgggaccggcacgaccggcgagacgctcggcgagaagtggaagcggcaactcaactcactggaccgaaaagagttcgaggagtacaagcggtccggaatcctggaagtcgaccgaacagaagcgaagtccgccttaaaggacggatcaaagatcaagtacgcagtctcccggggcacgtccaagatccgctggatcgtggaaagaggaatggtgaagccgaagggcaaggtagtggacctagggtgcggtcgcggcggatggtcctactacatggctaccttgaagaacgtgacagaggtcaagggctataccaagggcggccctgggcacgaagagcctatcccaatggcgacctacggctggaacctcgtgaaactgcatagcggcgtggacgtcttctataaaccgaccgagcaggtcgacacccttctctgcgacataggagaaagtagctccaaccccacgatcgaggagggccggaccctgcgtgtgctgaaaatggtcgagccctggctctcgtccaagcccgagttctgcatcaaggtgctcaacccgtacatgcccacagtaatcgaggaactggagaaactccagagacggtacggcggcagtctcgttcgctgccctctcagccgcaacagtacccacgagatgtactgggtaagcggcgtctccgggaacatcgtgagctcggtgaacacgaccagcaagatgcttctcaaccggtttactacacgacaccgcaagccaacatacgagcgggacgccgacctgggcgccgggacccgctccgttagcactgagacggagaagccggacatgacgatcatcggccggcgcctgcaacggctgcaagaggagcacaaggaaacctggcactacgaccacgagaacccctaccggacgtgggcctaccacgggagttacgaggccccgtccaccggctccgcgtcttccatggtgaacggcgtggtcaagctgctgacgaagccgtgggacgtggtgcctatggttacccagctggccatgaccgatacaacccctttcggccagcagcgggtgttcaaggagaaagtggacaccaggactccccagccgaaacccggtacccgggtcgtgatgaccaccaccgctaactggctctggacccttctggggcgcaagaagaacccccggctgtgtacgcgcgaggaattcatcagcaaggtgcggctgaacgccgcgatcggcgcggtattccaggaggagcaagggtggaccagcgcgagcgaggccgtaaacgactcccgcttttgggagctagtggacaaggagcgggccctgcaccaggagggtaagtgcgagtcatgcgtatacaatatgatggggaagcgcgagaagaagctgggggaattcggacgcgccaaagggtccagggcgatctggtacatgtggctcggggccaggttcctggaatttgaagcgctgggattcctcaatgaggaccactggttcggccgggagaatagctggtctggcgtggagggggagggtttacaccgcctggggtacattctggaggatatcgacaagaaggacggagacctgatttacgccgacgacaccgcgggctgggatactcggatcactgaggatgacctcctcaatgaggaacttatcaccgagcagatggcgccccaccacaagatactagcgaaggctatcttcaagctcacttaccagaacaaggtggtcaaggtgctgcgcccgacccctaagggggccgtgatggacatcatatcccggaaggaccagcgaggctcaggtcaggtcggtacctacggcttaaacacgttcaccaacatggaggtgcagctcatccggcaaatggaggcggagggcgtaattacgagagatgacatgcacaaccctaagggcctgaaggaacgtgtggagaagtggctgaaggaatgcggggtggaccgcctcaagcggatggccatttccggcgacgactgtgtagtcaagcccctcgatgagcgtttcagcacctcccttctgtttcttaatgacatggggaaggtgcggaaggacatcccgcagtgggagcccagcaaaggctggaagaactggcaagaggtgccgttttgctcccaccacttccacaaaatcttcatgaaggatgggcgcagcttagtcgtgccctgtcggaatcaggatgagctcatcggtcgcgcccgcatctcccagggtgcaggctggtcgctgcgcgagacggcctgcctgggcaaggcatacgcccagatgtggagcctcatgtacttccaccggcgtgacctgcgccttgcgtctatggcgatatgctccgccgtgccgaccgagtggttccccactagcagaaccacctggtccatccacgcccatcaccaatggatgaccaccgaggacatgttaaaagtctggaaccgcgtgtggatcgaggacaaccccaacatgatcgacaagacccccgtgcacagctgggaagacatcccgtacctggggaagagggaggacctgtggtgcggctccctcatcgggctgtcctcgagggccacgtgggccaagaacatccacacagcgatcacccaggtccggaatcttatcggcaaggaggagtatgtggactacatgccagctatgcgccggtactcggcgcactttgagagtgagggcgtgctttga

SEQ ID NO: 26285 - RNA, 9867 nt, synthetic construct
  misc_feature 1..9867: note = derived and/or modified CDS sequence (opt11) from DENV-4__JN638572__SS-prME
  source 1..9867: mol_type = other RNA
tcgacgataaccctcctctgcctgattcccaccgtaatggccttccacctgtcgacacgagatggggagccgctaatgatagtagcaaaacatgaacgtgggcgcccactcctgtttaaaaccacagaagggattaataaatgcacactcatagcgatggacctaggcgaaatgtgtgaagacacggtaacatacaagtgcccactcctcgtgaatacggaacccgaagacatcgactgctggtgtaacttgacaagcgcatgggtgatgtacgggacttgcacccagtccggggaacgccgcagagagaaacggagtgtggccctgaccccacactcaggtatgggcctcgaaacaagagcggaaacgtggatgagcagcgaaggcgcctggaaacacgcccaacgagtcgaaagctggattctccgcaatccagggttcgctttgctcgcgggcttcatggcatatatgatcggccaaacagggatccagcgaacagtcttcttcatattaatgatgctagtcgcacctagttacggaatgcgctgcgtaggagtgggaaaccgagatttcgtagagggagtcagcggaggtgcttgggtggacctagtgctagagcatggcggatgcgtcaccacaatggcccaaggtaaacccacactcgacttcgaactcattaaaaccacagctaaagaagtcgcactgcttcggacatactgtatcgaagcaagcatctcaaacataacgaccgcaacacgctgccccacccaaggtgagccctaccttaaagaagaacaagaccaacagtacatctgccgccgagacatggtggatagagggtggggaaacggatgcggacttttcgggaaaggaggcgtcgtaacctgcgcaaagtttagttgcctcgggaaaataactgggaacttagtgcaaatagaaaacctggaatacacggtggtcgtcaccgtgcacaatggcgacactcatgcagtaggtaacgacacaagcaatcacggggttacagcgaccataacaccgagaagcccatcggtagaagtaaagctccccgagtacggtgaattaacactagactgcgagccacgttccggtatcgacttcaacgaaatgatactaatgaaaatgaaaaccaaaacgtggctcgtacataagcaatggttcctggacctaccgctcccatggacaacgggggccgacaccctcgaggtacactggaaccacaaagaaagaatggtgaccttcaaagtaccgcacgcgaaacgccaggacgtcaccgtattgggatcacaagaaggtgcgatgcacagtgccctagcaggggcaacagaagtagattccggggacgggaatcacatgttcgcgggtcaccttaaatgtaaagtacgaatggaaaaactcagaattaaagggatgtcctataccatgtgttccggaaaattctcaatcgacaaagaaatggcagaaacacaacatggtacaacggtcgtcaaggtaaaatatgagggcaccggagcaccgtgcaaggtcccaatcgaaatcagagacgtaaataaggaaaaagtagtaggaagaataatttcgagcactcctttcgcagaaaacaccaacagcgtaaccaatatagaattggagccgcctttcggggatagctatatagtcatcggagttggcgatggcgcactgacactgcactggttcaggaaaggaagctccattggcaagatgtttgaatcaacgtacagaggagcaaaaaggatggcaatcttaggcgaaaccgcgtgggactttggtagtgtcggagggttattgacctccttaggaaaagcggtccaccaagtctttggcagcgtatataccaccatgttcggcggcgtttcttggatggttcgcatcctgattggcctactggtactatggattggaacgaatagccgaaacacatcgatggccatgagctgcattgcagtcggtgggattacgctgtttttgggattcaccgtccatgccgacatgggctgcgttgtttcctggtcaggcaaagaactaaaatgtgggagcggtgtcttcgtgatagacaatgtccacacatggaccgagcagtacaaattccagccggaaagcccggctagactcgcatccgccatactgaacgctcacaaagagggagtatgtgggatcaggagtacaacacggctagagaatgtaatgtggaagcaaatcaccaatgagctgaactacgtgctctgggaaggagggcatgacctaacggtagtcgccggcgacgtgaaaggggtgctcagcaaaggaaagcgagcgctcgcccctcccgttaatgacctcaaatactcgtggaaaacctggggcaaggcaaaaatatttactcccgaaacacgcaactccacattcctggtcgacggccccgacacctccgagtgcccaaacgagagacgagcttggaactttctagaggtagaggactacggctttgggatgtttaccacaaacatttggatgaagttccgagaaggctcatcggaggtatgcgaccatagactcatgtccgccgctataaaggaccaaaaagctgtacacgccgatatgggctattggatagaatcctccaagaaccagacctggcaaatcgagaaagcctcattgatcgaggtaaagacctgcctatggccgaagacccacacgctctggagcaacggagttttagaaagtcaaatgcttatacccaaggcatacgcgggtccaatctcccagcataactacaggcagggctacgcaacccagacggccgggccctggcacctaggcaaactggagatagatttcggcgaatgtccaggaactaccgtgacggtccaggaagattgcgaccaccggggacctagcctacgcaccacaacagcgagtggtaaattagtcacacaatggtgctgcaggagttgcacgatgcccccgctacggttcctgggcgaagatggttgctggtacggcatggagattagacctctcaacgagaaagaggaaaacatggtaaaatcccaagtgagcgcaggccagggaacaagcgaaacattttccatgggccttctgtgtctaaccctgttcgtagaagaatgcctaaggcgccgagtcacccgaaaacatatgatcctggtggtggttacaaccctgtgtgccattatccttggcgggcttacttggatggatctgctcagggcactcatcatgctaggagacacaatgagtggacgaatgggaggccagatacacctagcaatcatggctgtcttcaaaatgtcccctggatacgtgctaggcatcttcctcagaaaactaaccagtcgagaaactgcgctgatggtaatcgggatggccatgaccaccgtcctagccatcccacacgacttaatggagttcatcgatgggatctcgctagggctcatactcctcaagatggtcacacacttcgacaacacacaggtaggaaccttagctttggccctcacattcataaaaagtacaatgcccctagtgatggcatggcgcacgattatggcagtgctattcgtagtgacgcttatcccactgtgcagaaccagctgcctgcagaaacaaagtcactgggtagagataacagccctcatactgggcgcccaagcactccccgtatacctcatgactctaatgaaaggcgcaagcaaaaggtcgtggccactcaatgagggcataatggccgtggggcttgtcagcctcctggggagcgcgctcctgaaaaatgatgtcccattagcagggcccatggttgcgggcggcttactgctggcagcctacgtaatgagcgggagttcagcagacctcagcctggaaaaggcagccaacgtgaggtgggacgaaatggcggatataacaggcagtagcccaataatcgaagtcaaacaagatgaggacgggtcattctcaatcagggacgtagaggagactaatatgattaccctgctagttaagctggcgttgataaccgtaagcggtctctatcccctggcaataccggtcacaatgactctttggtacatgtggcaagtgaagacacaacgatccggagccctttgggacgtcccctcccccgccgcagctcaaaaagcgaccctaacggagggggtctacagaatcatgcaaaggggtttatttggaaaaacccaagtcggggtggggattcacacggaaggcgttttccacacgatgtggcatgtcacaagaggatctgtcatctgtcacgaatcaggccgcctagagccctcatgggccgacgttcgtaacgatatgatctcctacggaggaggatggcgcctcggggacaagtgggacaaagaagaagatgtacaggtgcttgccatcgaaccaggcaaaaaccccaaacacgtacaaactaagcccgggttgttcaaaacgctgactggggaaatcggtgcggtaactctcgacttcaagccgggaacgagcggttctccaatcatcaaccgcaaaggaaaagtaataggactatatggaaatggagtcgtcacgaaatcaggggactacgtcagcgcgatcactcaagcagaacgcataggagagcccgactatgaggtcgacgaagacatcttcaggaagaaacggctaacgatcatggatctacatcccggagccggtaaaacaaaacgaatactgccatcaatagtgcgcgaggccctaaagcgtcgtctgcgaaccctgatactggcacccacccgagttgtggcagcagaaatggaagaagccctaagaggcttaccaattagataccagacccctgccgtcaaaagtgaacatacgggtcgcgagattgtagacctaatgtgccacgccaccttcactacgcggctgctcagtagtacaagagtgccaaactacaacctcatcgtcatggatgaggctcactttaccgacccaagctccgtcgccgccagggggtacatatcaacccgggtcgagatgggtgaggccgcagcaatctttatgacggccacgcccccagggacgacagatcctttcccccaaagtaactcgccaatcgaagacatcgagcgggaaattccagaacgatcctggaacacgggattcgactggatcaccgactaccaaggaaaaacagtctggtttgtaccatccataaaggccggaaacgacatagcgaactgcctcaggaagtcagggaagaaggtaatacagctatcccgtaagactttcgacacggagtacccaaaaaccaaactcacagactgggacttcgtggtcaccactgacatctccgaaatgggcgcaaatttccgggccggaagagtaatcgacccgcgacgctgtctgaaacctgtaatactcacggatggaccagaaagagtcatactggcgggacccatacccgtaaccccagcatcagctgcgcagcgacgcggccgcatcgggcgcaatccagcccaagaggacgaccaatacgtcttctctggagatcccctaaggaacgacgaggatcacgcccactggacggaagcaaagatgctactagacaacatatacaccccagaggggattatacccacactctttgggccagagagggaaaagacacaagcgatcgacggagagtttaggctacgcggcgaacaaagaaagactttcgtggagctaatgaggcggggagatttgccggtgtggctaagttacaaggtagcaagtgcaggaatatcgtacaaagatcgtgagtggtgcttcacaggagaacgtaacaatcagatccttgaagagaatatggaagtcgagatatggacaagagagggcgagaagaaaaagctaagacctaagtggctcgacgcaagagtgtacgcggaccccatggcgctaaaagatttcaaggaatttgcgagtggccgaaaaagcataactctagacattctcaccgaaatcgcgagcctacccacctatcttagctccagagctaaactagcactggacaatatcgtcatgctgcatacaaccgagcgaggcggcaaagcctaccagcatgccttaaacgagctccccgagagcctcgaaacactcatgctggtcgcactactcggcgccatgacggctggaatattcctcttctttatgcaaggaaaggggataggcaaactatccatggggctaatagccatagccgtggcttcaggtttactctgggttgcagaaatacagccccaatggatagcagcctcgatcatacttgagttctttcttatggtcctcctcgttccagaaccagaaaagcaacgaacaccccaggacaatcagttgatttacgtgatcctcaccatacttactataatcgccttagtagcagcaaacgagatgggactgatagagaaaacgaaaaccgactttggtttctatcaggtgaaagcggaaacaacgattctagacgtagacctacgcccggcgtcggcatggacactatacgccgtcgccacgacgatactcacacccatgctcaggcacacaatagagaacacctccgcaaacctatccctagcggccatagcgaatcaagcagcagtcctgatgggtctcggaaaggggtggccactccacagaatggacttaggcgtgccattgctggcaatgggatgctacagccaagtgaacccgaccaccctaaccgctagcctagtgatgctgctagtccactacgccattataggaccgggccttcaggcaaaggcaacacgcgaagcccagaaacgtactgcagcggggataatgaaaaatccaaccgtcgacggaatcacggtgatcgacttggaacctattagctacgacccaaaattcgaaaaacagctgggccaagtcatgcttctagtcctctgtgtagggcaattacttctcatgcgaacaacatgggcactctgtgaagtattaaccctagcaacaggaccgataatgacactatgggaaggcaacccagggagattctggaacacgacgatcgctgtaagcacagccaacatcttccgaggttcctacctcgcgggcgccggactggcattttccctcatcaagaacgcccagacgccccgcagagggaccggcacgacaggagaaacgttgggagagaagtggaaacggcaactaaattccctcgaccgcaaagaatttgaagaatacaagcggtcaggaatcctagaagtcgaccgcaccgaagcaaaaagtgccctacgcgacggctccaaaacaaaacacgccgtctctcgaggatcaagcaaaataaggtggatagtcgagcgcggaatgattaaaccaaaaggtaaggtggtggacctcggctgcggaaggggcggctggagctactacatggcaacgttgcaaaacgttacggaagtaaagggttacacgaaaggagggcccggacacgaagaaccgatccccatggcaacctacggctggaacctagttaaactccactcaggagtagatgtattttacaaacctacagaacaagtagacacgttgctgtgcgacatcggcgagtcatccagtaacccgaccatagaagaaggaagaactctgagggtgctgaagatggtcgagccgtggctaagcagtaaaccggaattttgcataaaagtcttaaacccttacatgccaacagtcatagaggaactggagaagctgcaaaggcgctacggcgggtcactggtaagatgtcccttgagccgaaacagcacacacgaaatgtactgggtgagcggcgtatccgggaacatagtctcctccgtcaacaccacaagtaagatgcttctaaaccgattcacgacacgccacaggaaaccgacttatgagagggacgcggatctaggtgcaggcacgaggtcggtctccacagagacagagaagccggacatgacgataataggaagacggttacaaaggctccaggaagaacacaaggagacctggcactatgaccatgagaacccgtaccgcacctgggcgtaccatggcagttatgaagcacctagcacgggaagcgcatccagtatggtcaacggggtcgtgaagttgttaacaaaaccctgggacgttgtccccatggtaacgcaactcgcaatgacagacacaacgccattcggccagcaacgggtattcaaagagaaagtggacactcgaactccccaaccgaaacccggaacccgagtcgtcatgacgacaacagccaactggttatggacattgttagggagaaagaaaaaccctagactgtgtacccgagaagagttcatttccaaagtcaggtcaaacgcagcgataggagccgttttccaggaggagcagggatggaccagcgcttcagaggcagtaaacgatagtcgattttgggagttagtcgacaaagaacgagccctacatcaagagggaaaatgcgagtcgtgtgtgtacaacatgatgggcaagagggagaagaaactgggagagttcgggagagcaaaaggatccagggccatctggtacatgtggctaggagcgcgtttcctggagtttgaggccctaggatttcttaacgaagatcactggttcggccgcgaaaacagctggtctggggtcgaaggcgaagggctacacagattgggctatatcctagaggacatcgataagaaagatggcgacctgatctatgcggacgacaccgcggggtgggacacccggattaccgaggacgatctactcaacgaggaattgattacagaacaaatggccccgcaccacaaggttctggcgaaagctatctttaaattaacgtatcagaacaaagtggtcaaagttctcagaccaacaccaaagggagccgtcatggacataataagccgcaaagaccagcgcggctccggacaagtgggaacctatggcttaaacacctttacaaatatggaagtccaactcatacgccaaatggaggcggagggagttataacacgcgacgacatgcacaatcccaaaggattgaaagagcgagtcgaaaagtggcttaaagaatgtggggtagaccgtctaaagcgcatggcaatatcaggagacgattgcgtcgtcaaaccgctagatgaacggttcagcacgagcctactcttcctaaacgacatgggaaaagtccggaaagacatcccacaatgggaaccgagcaaaggctggaaaaattggcaggaagtgcccttttgttcccaccacttccacaaaatcttcatgaaggacggacgaagcctagttgttccttgccgcaaccaggatgagctaattggccgagcgaggattagccaaggggctggctggagcctgcgagagactgcctgtctcggcaaggcctatgcacaaatgtggagcttaatgtacttccaccgtcgagacctcagactagcctctatggccatctgcagtgcggtaccaaccgagtggtttccaacctcaaggacgacttggtccatccacgcacaccatcaatggatgaccacggaggatatgctcaaagtatggaatcgggtctggatcgaagacaatccgaacatgacagataagacaccagtccattcatgggaggacatcccctacctaggaaaacgggaggacctctggtgtggcagcctaataggcttatcaagccgcgcaacctgggctaagaacatccatacggcgataactcaggtacgaaacctaataggaaaggaggaatacatggactacatgccagtgatgaagcgttacagcgctcctagtgaatcagaaggagtcctatga

SEQ ID NO: 26286 - RNA, 9867 nt, synthetic construct
  misc_feature 1..9867: note = derived and/or modified CDS sequence (opt11) from DENV-4__JX024757__SS-prME
  source 1..9867: mol_type = other RNA
agcaccatgactctgctctgtctgattccaacggtgatggccttccacctctccacccgcgacggcgagccgctcatgatcgtggccaagcacgagcgagggcgccccctgctgttcaagaccaccgagggtatcaacaagtgtacgctcatagctatggacctaggtgaaatgtgcgaagacaccgtgacctacaaatgccctctgctcgtaaacaccgagcccgaagacatcgactgctggtgcaacctgacgagcacgtgggtgatgtacgggacctgcacccagtccggggagcggcggagggagaagcgctcagtggctctaacgccgcactctggcatgggactcgagaccagggccgagacatggatgtcgtcagagggcgcctggaagcatgcccagcgcgtggaatcctggatactgcggaaccccggcttcgctctgctcgccggttttatggcctatatgatcggccagaccgggatacagcgcacggtctttttcgttctgatgatgctggtggccccctcctacggcatgcgctgcgttggcgttgggaatcgcgacttcgtggaaggtgtaagcggcggtgcgtgggtggacctcgtcctggagcacggcggctgcgtcaccaccatggcccaaggcaaacccaccctggactttgagctaacgaagacaaccgccaaagaggtggcgctactgcggacctattgcatcgaggcctccatcagcaacataacgaccgcgacgcgctgtcccacgcagggggagccatacctcaaggaggagcaagatcagcagtacatctgccggcgcgacgttgtcgaccggggctgggggaacggctgcggcctattcggtaagggcggggtggtgacgtgcgccaagttcctctgctccggcaagattaccggaaacctcgtccagatcgagaacctggagtacaccgttgtggtcaccgtgcataacggcgatacgcatgccgtcggcaacgacacctccaaccacggggtgactgccacaatcacgcccaggtcccccagcgttgaggtcaagttgcctgactacggagagctcaccctggattgcgagccccggtccggcattgacttcaacgagatgatattaatgaagatgaagaaaaagacctggctcgtgcacaagcagtggttcctggaccttcccctcccctggagcgccggcgcggacacgtccgaagttcattggaactacaaggagcgcatggtcacctttaaggttccgcacgccaaacggcaggacgtgaccgtacttggttcccaggagggtgccatgcacagcgccctggcgggcgcaaccgaggtggactccggggatggcaatcacatgttcgccggccacctcaagtgcaaggtccgcatggagaagctccggatcaagggcatgagctacaccatgtgctccggcaaatttagcatcgataaggagatggcagaaacccagcatgggaccacagtagtcaaggtgaagtacgagggggctggggctccctgcaaggtaccgatagaaatcagagacgtgaacaaggagaaggtggttgggagaatcatatccagcacccccttcgcagaaaacaccaacagcgtgacgaacattgagttggagccaccgttcggggacagctacatcgtgatcggtgtcggcgactccgctctcactctgcactggttccggaagggatcttccatcggaaagatgttcgagtccacttaccgcggggccaagcggatggcaatcctgggggaaaccgcgtgggatttcgggtccgttggcggcctgttcacgagcctggggaaagccgtccatcaagtcttcggatccgtgtacacaaccatgttcgggggcgtgtcttggatgattcgcatcctaatcggttttctggtcctgtggatcggcaccaactccaggaacacgagcatggccatgacctgcatcgccgttggagggatcaccctgttcctgggtttcaccgtccaggccgacatgggatgcgtcgtctcctggaacggcaaagagttgaagtgcggttcgggcattttcgtggtggacaacgtgcacacgtggacggaacagtataagtttcagccggagtcacccgccaggttagcctcagccatactgaacgcacacaaagacggagtttgcgggatacggagcacaacgcgcctcgagaacgtcatgtggaagcagattacgaacgagctgaattacgttttgtgggaagggggccacgatcttaccgtcgttgctggcgacgtaaagggtgtgctgaccaagggtaagcgtgcactcacaccgcccgtcaacgacctcaagtactcctggaagacgtgggggaaggccaagatcttcacccccgaggctagaaattcaaccttcctgatcgatgggcccgacacctcagagtgcccgaacggacggcgggcctggaacttcctggaagtcgaggattacgggttcggaatgttcacgaccaacatctggatgaaatttcgggagggctcatccgaggtgtgtgatcacagacttatgagcgcagcgataaaggaccagaaggccgttcacgcggacatggggtactggattgaatccagcaagaatcaaacctggcagattgagaaggcttcgctgatcgaggtgaagacctgcctatggcccaagacacacaccctctggagtaacggcgtgctggagtcccagatgctgataccccggagctacgcggggccgttttcccagcacaactaccgccagggctacgccacccaaaccgcagggccctggcacctgggcaaactggagatcgactttggcgagtgccccgggaccaccgttaccatccaggaagattgcgaccacagaggacccagcctgcgcaccaccactgcgtccgggaagttagtgacgcagtggtgttgtcgctcctgcaccatgccacctctgcggtttctaggcgaggacgggtgctggtacggaatggagatccgccccctcagcgagaaggaggaaaacatggtgaagtcccaggtgaccgccggccaggggactagcgagactttctccatgggcttgctatgtctcaccctgttcgttgaggagtgcttacggcgccgggtcacccgcaagtatatgatgctcgtggtagtaataactttctgcgcgattatcctcggcggactgacctggatggacctcctgcgggccctcatcatgctcggggataccatgagtgggcgcatcggtgggcagatccacttggcgatcatggcagtctttaagatgtcccccggctacgtactgggggtctttctgcggaaactgacaagccgcgaaaccgcgctgatggtgatcggtatggcgatgaccacggtgttctctatcccgcacgacctgatggaactcatcgacggcatcagcctgggccttatcctgctacggattgtcacccacttcgataacacccaagtgggtaccctcgccctgtcgctcaccttcatcagatcgaccacgcccctcgtgatggcctggcggaccatcatggctgtcttctttgtcgtgaccctgatccccctgtgtcgcacttcctgcctccaaaagcagagtcactgggtcgaaatcacggcgctgatactgggagcgcaggccctcccagtttacctaatgaccctgatgaaaggcgccagccgtagaagctggcctttaaacgagggtatcatggccgtaggcctggtctccctgctcggcagcgcgctgctgaagaacgacgtgcccctcgcagggcccatggtggccggcggtctcctgctcgccgcctacgtcatgtccggcagctccgcggacctgagcctcgaaaaggccgcaaacgtccagtgggacgagatggccgacatcaccgggagctcccccatcatcgaggtgaagcaggatgaggacggatcttttagtatccgggacgtcgaggagacaaacatgatcacactactggttaagctggccctcatcaccgtgtcaggcctttacccgctggcgatccccgtgaccatggccttatggtacatttggcaggtaaagacccaacgctcgggggcactatgggatgttcctagcccagcggccacgcaaaaggcgactctctccgagggcgtctaccgaatcatgcagcgcgggctgttcggcaagacacaggtgggggtgggaatacacatggaaggcgtcttccacactatgtggcacgtgacgcgggggagcgtgatctgtcacgaaactggcaggctggaaccgagctgggccgatgtccggaatgacatgatcagctacgggggcggttggcggttaggggacaagtgggacaaggaagaggacgtccaagtgctcgccatcgagcccggcaagaaccccaagcatgtccagaccaagccggggctgttcaaaaccctgacaggggagattggggccgttacgctggactttaagccgggcacttcaggctccccgatcatcaataaaaaggggaaggtgatcggcctgtacgggaacggcgtcgtgaccaagtccggggactacgtaagcgccatcacccaggcggagcgtatcggcgaacccgactacgaagtcgatgaggacatcttccggaagaagcgcctgacgatcatggacctccatcccggcgccggaaagactaagagaatcctgccatccatagtgcgggaggcgctgaagcggcgcctccggaccttgatcctggccccaacccgcgtggtcgcggcggaaatggaagaggccctgcgaggccttcctatacggtaccagactccggccgtcaagtccgagcacaccggacgggagatcgtggacctgatgtgccacgccacttttaccacgcgcctgctttcctccacccgggtaccgaactacaacctgatagtcatggacgaggcacacttcactgacccttgttccgtcgctgcgaggggatacatcagcactcgggtcgagatgggggaggcggccgcaatattcatgaccgctacgccaccgggtagcatcgacccctttccacagtccaactcacccatcgaggacatagagagagagataccggagcggtcctggaacactggttttgactggattaccgattaccagggaaagacggtgtggtttgtgccttccatcaaagccgggaacgacatcgccaactgcctgcgcaaatccgggaagcgcgtgatacaactatctcggaagacttttgacaccgagtaccccaagacgaagctgacggactgggacttcgttgtcaccaccgatatctctgagatgggcgccaactttcgcgcggggcgggtgatcgaccccagaaggtgcctgaagccggtaatactcaccgacggcccggagcgcgtcatactggccggccccatccccgtgacgcccgccagcgccgcgcagagacgcgggcggatcggtagaaaccccgcccaggaggacgatcagtacgtcttctccggggaccccctgaagaatgacgaagaccatgcccactggacggaggccaagatgctcctggacaacatctacacccccgagggcattatcccgaccctgttcggccccgagcgggagaagacacaagccatcgacggtgagtttcgcctccggggtgagcagcgcaagacgttcgtggagctgatgcggcgcggcgacctgccggtgtggctcagctacaaggtggcgtccgccggcatcagctacaaggaccgtgagtggtgcttcacgggtgagcgcaacaaccagattctggaagagaacatggaggtcgagatctggacacgggagggcgaaaagaaaaagctgcggcccaagtggctcgatgcaagagtctacgctgacccgatggcgctgaaggacttcaaggagttcgcatccggccggaaaagcatcaccctggacatcttaaccgagatcgccaccctgccgacctacctttcgagcaaagctaagctggcattagacaatatagtgatgcttcacactactgaaaaagggggcagagcctaccagcacgcgctcaacgagctgcccgagtccctggagacgcttatgctggttgcattactcggcgctctgaccgccggcatcttcctgttcttcatgcaggggaaaggcatcggcaagctcagcatggggctgattgcgatcgccgttgcgagcggcttgctctgggtggccgagatacagccgcagtggatcgcggcctcaataatcctggagtttttcctgatggtgctcctaattcccgagcccgagaagcagcggacacctcaggataaccagttaatctatgttatcctaacgatcctaaccattatcggcctgatcgccgctaacgagatggggctcatcgagaagactaagaccgacttcgggttctaccaggtaaagacagaaactacgatacttgatgtcgacctgcgcccagcctctgcttggaccctctatgcggtggcaacgaccatacttactcccatgctgcggcacaccatagagaacacgtccgcgaatctctcgttggcggccatagcaaaccaggccgctgtcctaatgggcctcggcaaggggtggcccctgcatcgcatggacctgggagtgcctttacttgcgatggggtgctattcacaggtcaaccctaccacgctgacggcctctcttgtgatgctgctggtacactacgcgattataggccccggcctccaggccaaggccacacgggaggcccagaaacgcaccgcggccgggatcatgaagaaccccaccgtcgacggcatcaccgtgatcgacctggagcccatctcctacgacccgaagtttgagaagcagttggggcaggtcatgctcctggttctctgcgtggggcagcttcttctgatgcggacgacgtgggccctctgcgaggttctgaccctggccacgggtccaataatgacgctctgggagggcaaccccggccgcttctggaataccaccatcgctgtgagcacggcgaacatattccgggggtcctacctggccggcgccgggcttgccttcagcctcatcaagaacgctcagactccccgccggggaactggaaccaccggcgagacactgggcgaaaagtggaagcgccagttgaatagcttagaccgtaaggagttcgaagaatataagcgctctggaatcctggaggtggaccgcaccgaggcgaagtctgcccttagagacggcagcaagattaagcacgcagtatcccgggggagctccaagatccgctggatcgtcgagcggggaatgatcaaaccgaaggggaaggtggttgacctcggctgcggccgcgggggttggagctattatatggctacgctgaagaacgtgaccgaagtaaaggggtacaccaagggcgggcccggccatgaggaacccatacccatggcgacgtacggctggaacctggtgaagctacactccggggtggatgtgttctacaagccgactgagcaggtagacacactgctgtgtgacatcggggaaagctcctcgaaccccaccatagaggaggggaggacgcttagggtgctgaagatggtagagccctggcttagcagcaagcccgagttttgtatcaaagtcttgaacccatacatgcccaccgtgatcgaggagttagaaaaactgcaacgccgtcatggcgggtcattggtacgatgccccctttccaggaatagcacgcacgagatgtactgggtatccggtgcgagcggcaacatagtgtcctcggtcaacaccatctcgaagatgctgctgaacaggttcacgaccaggcaccgcaaacccacctatgaaaaggacgtggacctcggggcggggacccgtagcgtgtccacggaaactgagaagccggacatgactataattgggcgccggctgcagagactgagagaggaacacaaggaaacctggcactacgaccaagagaacccctatcgtacgtgggcctaccacggcagctacgaggccccctccacgggcagcgcttccagtatggtgaatggggtggtgaagctactgaccaagccgtgggacgtaatccccatggtgacccaactggcgatgacggacaccactccttttgggcagcagcgggttttcaaggagaaggtcgatacccgaacgccccaacctaagcccggaacccggatgatcatgacaatgaccgccaactggctctgggcgctgctggggaagaagaagtctccgcgcctgtgtacgagagaggagttcatatcgaaggtgcgcagcaacgcggccattggggctgttttccaagaggagcagggctggaccagcgccagcgaggccgtcaacgactcccggttttgggagctggtggacaaggagcgtgcattacaccaggagggcaagtgcgagtcttgtgtgtataatatgatggggaagcgcgagaagaagctcggcgagtttgggagagccaaggggtcccgcgccatctggtacatgtggcttggcgctaggtttctggagttcgaggctctcggcttcctcaacgaggaccactggtttagccgcgagaactcctggagtggcgtagagggggaaggcctgcacaggctggggtacatcctggaagacatcgacaaaaaggacggtgacctgatctacgccgacgacacggcgggatgggatactcgcatcacagaggacgacctcttaaatgaggagctgataaccgagcagatggcaccgcaccataagacgttggccaaggccatctttaagctaacctaccaaaacaaagtggtgaaggtcctccggcccacgccgaagggggccgtaatggacataatctcccgcaaggaccagcggggcagcggacaggtgggcacatacggccttaacacctttaccaatatggaagtccagctaatccgccagatggaggcggagggcgtgatcacccaagacgacatgcagaacccccggggcctaaaggagcgcgtcgagaagtggctcaaggagtgcggggtggaccgactgaagcgtatggccatctccggagatgactgcgtggtgaagcccatcgacgagcggttcagcacctcactcctgttcttgaacgacatgggaaaagtcaggaaggacattccgcagtgggagccgtcgaagggctggaagaactggcaggaggttcccttctgctcccaccacttccacaaaatcttcatgaaggatggacgcagcctggtagtcccctgccgcaaccaagacgaactaattggccgggcccgcatcagtcaaggcgccgggtggagcctgcgcgagacggcgtgcttaggcaaggcttatgcacagatgtggtccttgatgtactttcacagacgcgacctgcggctggcgagcatggccatatgcagcgctgttccgacggagtggttccccacatcccgcacgacctggtcaatacacgcccatcaccagtggatgacaaccgaggatatgctcaaggtgtggaaccgggtgtggatagaggacaaccccaacatgacggacaagacccccgtgcacagctgggaggacatcccgtacttagggaagagagaggatctgtggtgcggcagcttaatcgggctgtccagccgggccacttgggccaaaaatatccataccgccatcacccaagtgagaaacctcatcggcaaagaagagtacgtagactatatgccggctatgaagcggtactccgcgccctttgaaagtgagggcgtactataa

SEQ ID NO: 26287 - RNA, 9867 nt, synthetic construct
  misc_feature 1..9867: note = derived and/or modified CDS sequence (opt11) from DENV-4__JF741967__SS-prME
  source 1..9867: mol_type = other RNA
tccaccatgactctgctctgtctgatccctaccgttatggccttccatctatccacccgggatggcgagccgctcatgatcgtggcgaagcatgagcgggggcgccccctgctgttcaagaccaccgagggcatcaacaagtgcacgctcatcgcgatggacttaggggagatgtgcgaggacaccgtgacctacaagtgcccgttgctcgttaacaccgagcccgaggacatcgactgctggtgcaacctgacgtcaacctgggtcatgtacgggacctgcacccaaagcggggagcgccgccgggagaagcgcagcgttgcgctgacgccgcactccggcatgggcctcgagacccgggcggagacctggatgagctcagagggggcctggaagcacgcgcagcgcgtggagagctggatactgcggaaccccggcttcgccctgctcgcagggttcatggcctatatgatcggccagaccgggatccagcgaacagtcttcttcgtgttgatgatgctggtcgccccctcatacggcatgcggtgcgtcggagtggggaaccgcgacttcgtggaaggcgtcagcgggggggcgtgggtggacctcgtgctagaacacggggggtgcgttaccaccatggcccaggggaagcccaccctggacttcgagctcacgaagaccaccgccaaggaggtggctctgctgagaacatactgcatcgaggcatccatcagcaacatcacgaccgcgacacgctgcccgacccaaggggagccctacctcaaggaggagcaggaccagcagtacatctgtagacgcgacgtggttgaccggggctgggggaacgggtgcggcttattcgggaagggtggggtagtgacgtgcgccaaattcctatgcagtggcaagatcacagggaacctagtccaaatcgagaacctggaatacaccgtggtggtcaccgtgcacaacgggaacacacacgccgtgggcaacgatacgtcaaaccacggggtgaccgcgacaataacgccccgctcccccagcgtagaggtcaagctgccggactacggggagctaaccctggactgtgagccccggtccgggatcgacttcaacgagatgatccttatgaagatgaagaaaaagacctggctcgtgcacaagcagtggttcctggacttgcccttgccctggacggccggcgcggacacaagcgaggtgcactggaattacaaggaacgcatggtcacgttcaaggtgccgcacgccaaacgacaggacgtgaccgtcctggggagtcaagagggcgcgatgcatagcgctctggccggcgcgaccgaggttgatagcggggatggaaatcacatgttcgctgggcatctcaagtgcaaggtcaggatggagaagttgcgcatcaagggcatgtcctacaccatgtgcagcggcaagttctcgatcgataaagagatggccgagacgcagcatgggaccaccgtcgttaaggtgaagtacgaaggcgccggggccccctgcaaggtccccatcgagatccgggacgtaaataaagagaaggtggtcggccggatcatcagctccacgcccttcgcggagaacactaacagcgtgactaatatcgagctggagccgccgttcggggactcttacatcgtaatcggcgtcggagatagcgccctcacccttcactggttccggaagggatccagcatcggcaagatgttcgagtccacctaccgcggggctaagcggatggccatactgggcgagacggcctgggacttcgggagcgtcggcgggctcttcacctccctgggcaaggccgtgcaccaggtcttcgggagcgtgtacactaccatgttcgggggcgtgtcctggatgatccgtatcctgatcgggttcctcgttctgtggattggcacgaacagccggaacacctccatggccatgacgtgcatcgctgtgggcgggatcacgctgttcctcggtttcacggtgcaggccgacatgggatgcgtcgtgagctggaacggcaaggagttaaaatgcgggtccggcatcttcgttgtggacaacgtgcacacctggactgagcagtataagttccagcccgagagccccgcgcgccttgccagcgccatcttgaacgcccacaaggacggcgtgtgcgggatccgatccaccacgcgcctcgaaaatgtcatgtggaagcagatcacaaacgagctgaattacgtgctgtgggaaggcgggcacgaccttacggtggtcgcaggcgacgtgaagggagtactcacaaaggggaagcgggcgctgacgccgcccgtcaacgacttaaagtacagctggaagacttggggcaaggccaagatcttcacccccgaggcccgcaattccaccttcctgatcgacgggcccgacacgagcgaatgcccgaatgaacggagagcgtggaacttcttcgaggtggaagactacggcttcgggatgttcaccacgaacatctggatgaagttccgggagggctcttctgaggtgtgcgaccaccgcctaatgtccgccgcgatcaaggaccagaaagccgtccacgccgacatgggctactggatcgagagctccaagaaccaaacctggcaaatagagaaggctagcctcatcgaggtgaagacatgtctatggcccaagacacacaccctgtggtcgaacggggtgctcgagagccaaatgctgatcccccgttcttacgccggcccgtttagccagcacaactatcgccaggggtatgctacccagaccgccggcccctggcatttggggaagcttgaaatcgacttcggcgagtgccccggcacgaccgtcaccatccaagaggattgcgaccaccgggggccctccctccgcactaccaccgcaagtggcaagctggtgacccaatggtgctgccgcagttgcaccatgccgcctctccggttcctgggggaggacggctgctggtacgggatggagattcgccccctgagcgagaaggaagagaacatggtgaagagtcaggtcacggccggtcagggcacctccgaaaccttcagcatgggcctcctgtgcctgaccctgttcgtggaggagtgccttcggcgccgagttaccaggaaacacatgatcttggccgtggtgatcaccttctgcgccataatcctcggtgggctgacctggatggacttgcttcgggtcctgatcatgctgggcgacaccatgagtgggcgcatcgggggccagatccacctcgccatcatggccgtgttcaaaatgtcacccgggtacgtgctgggcgtcttcctgcggaagctcacgtcccgcgagaccgcgctgatggtcatcgggatggcgatgaccaccgtgttcagcatccctcacgacctgatggagctcatcgatggcatctccctaggcctcatcctcctcaagatcgtcacgcatttcgacaatacgcaggtcggcactctggccctcagcctgaccttcatccgctctacgacgcccctggtgatggcttggcgcacaatcatggccgtcttctttgttgtcaccctgatccctttgtgccggacgagctgcctacagaagcagtcccattgggttgagatcaccgccctaatactcggcgcgcaagctcttcccgtgtacctcatgaccctgatgaagggggccagccgccggtcctggccgctgaacgagggcatcatggccgtggggctcgtcagcctgctgggctccgcgctcctgaagaatgacgtgcccctggccggccccatggtggccgggggcctcctcctggccgcctacgtcatgagcgggtctagcgcggatctctcccttgaaaaggccgccaacgttcagtgggacgagatggccgacatcaccggcagcagccccatcatcgaggtgaagcaggacgaggacggatccttcagcatccgcgaagtagaggagacgaacatgatcaccctgctggtaaagctggccctgattaccgtgtccggactatacccgctggcgatccctgtcacaatggccctgtggtacgtgtggcaggtgaagacgcagcgcagcggcgccctctgggacgtcccgtcccccgccgccacccacaaggcgaccctgtccgagggggtttaccgcatcatgcagagaggcctgttcggcaagacccaggtaggggtcggtatccatatggaaggtgtgttccacaccgtaggtcatgtcacccgcgggtccgtgatctgccacgagaccggccggctcgagccaagctggggcgatgtgcgcaacgatatgatatcctacggcggggggtggcgcctgggggacaagtgggacaaagaggaagacgtccaagttctggccatcgagcccgggaagaaccccaagcacgttcagaccaagcccggcttgttcaagaccctcacgggggagatcggtgcagttaccctggacttcaaaccgggtaccagcgggagccccattatcaacaagaagggcaaggtgatcgggctctacggcaatggggtggtcactaagagcggcgattatgtgtccgccatcacgcaggccgagcggatcggcgagccggattatgaggtggacgaagacatattccgcaagaagcggttaaccataatggacttacatcctggagcgggcaagaccaagcgcatcctccccagcatcgtccgggaagccctaaagcgccgactccgcaccctcatcctggcgcccacgcgggtagtggccgcggagatggaggaggccctccgcgggctgccgatccggtaccagacaccggccgtgaagtccgagcacaccggccgcgaaattgtggacctcatgtgccacgccacttttactacccgtctgttgagctccacccgcgtccccaactataacctcatagttatggacgaggcccacttcacagacccctgcagcgtggcggcaagggggtacatcagtacgcgcgtcgagatgggtgaggcggccgctatattcatgaccgcgacacccccgggctccattgaccccttcccccagagcaattcccccatcgaggacatcgaaagagagatcccggagagaagttggaataccgggttcgattggatcacggactaccaaggtaagactgtgtggttcgtcccctccatcaaggccggcaatgacatcgccaactgcctgcgcaagtccggcaagcgcgtcatacagctgtcccgcaagaccttcgacaccgagtacccgaagacgaagctcaccgactgggacttcgtggtgaccaccgacatcagcgagatgggggccaatttccgggccggccgcgttatcgacccccggcgctgtctcaagccggtgatcctgacggacggccccgagcgggtgatactcgcggggcccatccccgtcaccccggcctctgccgcccagcgccgcggacgcatcggccggaaccctgcacaggaggacgatcaatacgtattcagcggcgaccccctgaagaacgacgaagaccacgctcactggacagaggccaagatgctgctcgacaacatctacacccccgagggcataatcccgacgcttttcgggcccgagcgcgagaagacgcaggccattgatggcgagttccggctgcgcggggagcagcggaaaaccttcgtggagctcatgcgccggggcgacttgcccgtatggctgagctacaaggtggccagcgcggggatctcctacaaggatcgagaatggtgcttcaccggtgaacggaacaaccagatcctcgaggagaatatggaggtcgagatctggactcgagagggagagaagaaaaagctgcgacccaagtggctggacgcacgcgtctacgctgacccgatggccttaaaggacttcaaggagttcgccagtgggcggaagtccataaccctggacatcctgaccgagatcgcgaccctaccaacctacctgagctccaaggccaagctggccctcgataacatcgtgatgctgcacacgaccgagaagggcgggcgcgcctaccaacacgccctgaatgagcttcccgagtcgctggagacattaatgctcgtagcgctgctgggcgctatgaccgctggtatcttcctcttcttcatgcagggcaagggcatcgggaagctgtccatgggcctgatcgccatagcggtcgcctccgggctcctgtgggttgcggagattcagccgcagtggatcgcagcatcgatcatcctggagttcttcctcatggtactactgatccccgagcctgagaagcagcgcacacctcaggacaatcagctcatctacgtaatcttaaccatccttacgataatcggcctcatcgcggccaatgagatggggctgatcgagaagaccaagacggatttcggcttctatcaggttaagccggagaccaccatcttagacgtggacctccggccggccagcgcctggaccctgtacgcagtggcgacgaccatcctgacccccatgctccgacacaccatcgagaacacgagcgccaacctgtccctggccgccatcgcgaaccaggcggccgtgctcatgggcctggggaagggctggcccttgcatcgaatggatctcggggtaccgcttctggccatgggctgttatagccaagtcaatcccaccaccctcaccgcctccctggtaatgctactcgtccactacgctattattggccccgggctacaagcgaaggccacgcgcgaggcccagaagcggaccgccgcaggcattatgaagaaccccaccgtcgacgggatcaccgtgatcgacttggaacccatcagctatgaccccaagttcgagaagcagctcggacaggtgatgctgctggtcctctgcgtggggcagctgctgctcatgcgcacgacctgggccctctgcgaagtacttaccctcgccaccggccctgtcatgactttatgggagggcaaccccgggcgcttttggaacacaacgatagccgtgtcgacggccaacatcttccgcggcagctacctggcgggggccggtctcgccttctccctgatcaagaacgcccagacgccgcgacgcgggaccggcaccaccggcgagacgctgggggagaagtggaaacggcaactcaattcattagaccgcaaggagttcgaggaatacaagcggtccggaatcctggaggtggacaggaccgaggccaagagcgcgctccgggacgggacgaagatcaagtacgccgtctcccggggcagctcgaagattcgatggatcgtggagagagggatgatcaaaccgaagggcaaggtggtcgacttaggctgcgggcggggcggctggtcttactacatggcaaccctgaaaaacgtgaccgaggtaaagggctacacaaaaggcgggcccggccacgaggaacccatccccatggccacctacgggtggaacttggttaagctgcactccggcgtagacgttttctacaagcccaccgagcaggtcgacaccctgctctgcgatatcggggaaagcagcagcaaccccacgatcgaggagggccgaactctgcgcgtgctgaaaatggtcgagccctggctctccagcaaaccggagttctgcatcaaggtgctgaacccctatatgccaaccgtgatcgaggagctggagaagctccagcgacgccacggcggatctctggtccggtgccccctgagtcgcaacagcacccacgagatgtattgggtgtccggagccagcggcaacatcgtgtccagcgtcaacacgatctccaagatgctgctcaacagattcacaacccgccacaggaagccgacgtacgagaaggacgtggacctgggagcggggacgcgcagcgtgtccaccgagactgagaagccggacatgacggtcatcggccggcgcctccagcggctcagggaggaacacaaggagacgtggcactacgaccaggaaaatccctaccggacctgggcctaccatggcagctacgaggccccgtccaccggtagcgcctcaagcatggtgaacggcgtcgtcaagctgctgaccaagccctgggacgtgatccccatggtgacgcagctcgcgatgacagacaccacccccttcgggcagcaacgcgtcttcaaggagaaggtggatacgcggaccccgcagcccaagcccggcacccgaatgataatgaccacgaccgccaactggctgtgggccctgctcgggaagaaaaagagtccgcggctgtgcaccagagaagagttcatctcaaaagtgcggagcaacgctgccatcggcgcggtctttcaggaagagcagggatggaccagcgcctctgaggccgtgaatgacagccgcttctgggagctggtagacaaggaacgggccctccaccaggaggggaagtgcgagagctgcgtgtacaacatgatgggcaagcgcgagaagaagctaggggagttcggccgcgccaaggggtccagggcgatctggtacatgtggctaggagcccgcttcctcgagttcgaggccctgggattcctgaacgaggatcattggttcagccgggagaattcatggagtggcgtggagggggaggggctccatcgtctgggctacatactagaggacatcgacaaaaaggatggcgacctcatctacgccgacgatacggccgggtgggacacccgaataacggaggatgacctgctgaacgaggagctcatcactgagcagatggccccccaccacaagacgctggccaaagccatcttcaagctgacctaccaaaacaaggtggtcaaagtcctccggcccacccccaagggcgcagtgatggacatcatctcacgcaaggaccagcgcgggagcggccaggtcgggacctacggcctgaacaccttcacaaacatggaggttcagctgatccgccagatggaagcagagggcgtgatcacacaggatgacatgcagaaccccaaggggctaaaggagcgcgtcgagaagtggctgaaggagtgtggcgtggacagactgaaacgcatggctatctccggggacgactgcgtggtcaagccgctcgacgagcggttctctacctccctgctgttcctcaacgacatgggcaaggtgcgcaaggacatcccccagtgggagcccagcaagggctggaagaactggcaggaggtgcccttctgcagccaccacttccacaagatatttatgaaggatggccggagcttggtcgtaccctgccgcaaccaagatgagctgatcggccgggcccgcatctcccagggagccggatggagcctgagggagaccgcctgtctggggaaagcttacgcacagatgtggtccctgatgtacttccaccgccgcgatctccggctggctagcatggccatctgctccgcagtgccgacagagtggttcccaaccagccgcaccacctggagcatccacgcgcaccaccagtggatgacgaccgaggacatgctaaaggtttggaaccgtgtgtggatcgaggacaaccccaatatgaccgacaaaaccccagtgcactcctgggaggacatcccatatctcggcaagcgggaggacctgtggtgcgggagcctgatcggcctctccagccgggccacgtgggccaagaacatccataccgcgatcactcaggtccgcaatctgatcggcaaggaggagtacgtggactatatgcccgcaatgaagcggtacagcgcgcccttcgaaagcgagggagttctgtga

SEQ ID NO: 26288 - RNA, 9867 nt, synthetic construct
  misc_feature 1..9867: note = derived and/or modified CDS sequence (opt11) from DENV-4__JQ822247__SS-prME
  source 1..9867: mol_type = other RNA
agcaccatgaccctgctttgcctgattcccacggttatggccttccacctcagcactcgagacggggagcccctcatgatcgtcgccaaacatgagcggggacgccccctgctgttcaagaccaccgagggcatcaacaaatgcacgctcatcgcgatggacctgggtgagatgtgcgaggacaccgtaacctacaagtgccctttactcgtgaacaccgagcccgaagacatagattgctggtgcaaccttaccagcacctgggtcatgtatgggacctgtacccagtccggagagcggcgccgggagaagcgctcggtcgccctgactccacactctggcatgggtctcgaaacgcgggccgagacctggatgagctccgagggtgcatggaaacatgcccaacgcgtggaaagctggatcctgagaaaccccggcttcgctctgctcgccggattcatggcctatatgatcggccaaaccggaatccaacgcacggtcttttttgtgctaatgatgctggtggccccctcatatggcatgcggtgcgtcggcgtggggaaccgagacttcgtggagggtgtcagcgggggcgcgtgggtggatctagtgctggagcacggcgggtgcgtgacgaccatggcccagggcaaaccgaccttggacttcgaactgacgaagactaccgccaaggaggtggccctgttacggacgtattgtattgaggcctccatcagcaatattacgaccgccacccgctgcccgacccagggggagccctacctcaaagaagagcaggatcagcagtacatttgccgtcgagacgtagtcgaccgcggttgggggaacggctgcggcctgttcggaaaggggggggtggttacgtgcgccaagttcctgtgttccggtaagataaccgggaatctagtccagattgagaacctcgagtacaccgtcgtggtcacagtacacaatggtaacacgcacgctgtcggaaacgataccagcaaccacggggtgacagccaccattacacctcgcagccccagcgtggaggtcaagctgcccgactatggcgagctcactttggactgcgagccccggtccggtatcgacttcaacgaaatgatactgatgaagatgaagaagaagacttggctcgtccacaagcagtggttcctggacttgccccttccttggaccgccggggcggacaccagcgaggtgcactggaattacaaggagcgcatggtcacgttcaaggtgccgcacgcaaagaggcaggacgtcaccgtcctggggtcccaggagggcgccatgcacagcgccctggcaggagcgacggaggtcgacagcggggacgggaatcacatgtttgccggacacctcaagtgcaaggtacgtatggaaaagctgcgtataaagggcatgtcgtacaccatgtgctcaggcaaattttcgatcgacaaggagatggcagagacgcagcatggtacaaccgtagtgaaggtgaagtatgagggcgctggggccccctgcaaggtccccatcgaaatccgggacgtgaacaaggagaaggtggtaggccgcatcatctcttccactcccttcgcggagaacacaaatagcgtgaccaacatcgaactggagccgcccttcggggactcctacatcgtgatcggcgtcggagactctgcgttgaccctgcactggttccgaaagggttccagcattggcaagatgttcgagtccacctaccgcggggccaagcggatggcaatactgggtgagacggcgtgggacttcggcagcgtcggcggcttgttcaccagtctggggaaggcggtgcaccaggtcttcggcagcgtttacaccactatgttcgggggggtatcctggatgatccgcattctcatcggcttcctcgtcttatggatcggcacgaatagcaggaacacatccatggccatgacctgcatcgccgtggggggcatcactctcttcctgggcttcacggtgcaggccgacatggggtgtgtcgtgtcttggaatggcaaggagctcaagtgtgggtccggcatcttcgtggtcgataacgttcacacatggaccgagcagtacaagttccagcccgagagccccgcgcgactggccagcgccatccttaacgctcacaaggacggcgtatgtggcattagatccaccacgcgcctcgaaaacgtcatgtggaaacagataacaaacgagttgaactacgtgctttgggagggtgggcatgacctcaccgtggtggccggagatgtgaaaggcgtactgaccaaggggaagcgcgcgctgacgccgcccgtcaacgacctaaaatacagctggaagacttggggcaaggccaagatattcacccccgaggccaggaactccaccttcctgatcgacggaccagacacgtccgagtgccccaacgagcggcgcgcctggaatttcttcgaggtcgaagactacgggtttgggatgttcacaaccaacatctggatgaagtttcgggaaggcagcagcgaggtgtgcgaccaccgcctgatgtccgctgcgattaaggatcagaaagccgtccacgctgacatggggtactggatcgagtcatctaaaaatcaaacatggcagatcgagaaggcaagcttgatcgaggtgaagacgtgcctgtggcccaagacccacaccctttggtccaacggcgtgctcgagagccagatgttgatcccccggtcctacgcgggtccgttcagccagcacaattaccgccaggggtacgccacccaaaccgcagggccgtggcacctgggaaagctggagatagactttggagagtgtcccggaactaccgtaaccatccaggaggattgtgatcaccgggggccatccctacgcaccaccaccgcctctggcaagctggtgacacaatggtgctgccgctcttgcaccatgccccccctccggttcctgggggaggacggttgctggtacgggatggaaatccgccccctgagcgaaaaggaagagaacatggtaaaaagccaggtgacggccggccagggcacatccgagacctttagcatggggttgctctgcctgaccctcttcgtggaggaatgtctgcggcgccgggtcacgcgcaagcacatgattctcgcggtcgtgattaccttctgcgccataatcctcggcggcttgacctggatggacctgctccgggtactgatcatgctgggagacaccatgtccggccgcatcgggggccaaatccatctcgccataatggccgtatttaaaatgagccccgggtacgtgctgggcgtatttctgcggaaactgacttcaagagaaaccgcactgatggtgataggtatggcgatgaccacggtgtttagcattccgcatgatcttatggagctcatagacggcatctccctaggcctgattctgctgaaaatcgttacgcacttcgataacacccaggtggggaccctggccctcagcttgactttcatacggtccacgacccccctcgtgatggcgtggcgtaccatcatggccgtctttttcgtagtgactctaatcccgctgtgccggacgagctgcctgcaaaagcagtctcattgggtcgagatcaccgcactcattctgggcgcgcaggccctgcctgtatacttgatgaccctgatgaagggggccagcaggcggagttggccactgaatgagggcatcatggccgtgggactcgtctctcttcttggctcagctttactgaagaatgacgtgcccctggccggcccaatggtcgccgggggcctgctgcttgccgcctatgtgatgagcggctctagtgcggacctctccttagaaaaggctgccaacgtccagtgggacgagatggcagacatcaccggctctagccccatcatcgaggtgaagcaagacgaggacggatcgtttagcatacgcgacgtggaggagacaaacatgatcaccctgctggtgaaactggccctaattacggtgtccggcctctaccccctggcgatccccgtcaccatggcgctttggtacgtgtggcaagtcaagacgcagcgatcgggcgccctatgggacgtcccctccccagccgcgacgcagaaagcgaccttaagtgagggtgtctaccgtatcatgcagcggggactgttcgggaagacccaagttggagtggggatccacatggagggggttttccataccatgtggcacgtaacgcggggctccgtgatctgccacgaaactgggagactagagccgagctgggccgacgtaaggaacgatatgatctcgtacggcgggggctggagactgggtgacaaatgggacaaagaggaggacgttcaggtcctagccatcgagcccgggaagaaccccaagcacgtgcagaccaagcccggcctcttcaaaacccttacaggggagataggcgccgtgaccctggacttcaagccggggaccagtggcagccccatcatcaataagaagggcaaggttattggtctctacggcaatggggtagtcactaagagcggagattacgtaagcgccattacgcaggccgagcggatcggggaacccgattacgaggtggatgaagacatcttcaggaagaagcggctgaccatcatggacctgcatccgggcgccggcaagaccaagcgtatcctccccagcatagtgcgggaggccctgaagcgccggctacgcacgctaatcctggcccctacgcgggtcgtcgcagcggaaatggaggaggccctgcgcgggcttcccatccggtaccaaactccggcagtgaaatccgagcacacgggcagggaaatcgttgacttaatgtgccacgccaccttcacaacgcggctgctgagctccaccagagtgcccaactacaacttgatcgtcatggacgaggcgcactttaccgatccgtgctcggtggccgcccgcgggtacatctccacgcgagttgagatgggcgaagccgccgcgattttcatgaccgccacacccccggggagcatcgacccctttccccagagcaactccccaatcgaagacatcgaaagagaaatcccggagcgcagctggaacacaggcttcgactggatcacggactatcagggcaagaccgtctggttcgtgccctccataaaggcggggaatgacatcgccaattgcctcagaaagagcggtaagcgcgttatccagctctcgcggaagaccttcgacaccgagtaccccaagaccaagctcacggactgggacttcgtcgtgaccaccgacatcagcgagatgggggccaacttccgggccggccgcgtgatcgacccacggcgctgtctgaagccagtcatcttaacggacggacccgaacgggtgatcctggcaggacctataccggtcaccccggcctctgctgcgcagcgccgggggaggattgggcggaacccggcgcaggaggacgaccagtacgtcttcagcggcgaccccctgaagaatgacgaggatcacgcccactggaccgaggccaagatgctgttggacaacatctacacacccgagggtatcatcccgacgctgttcggccccgagcgagagaagacccaggccatcgacggcgagttccggctgaggggggaacaacggaaaaccttcgtggaactcatgcgcagaggtgacctccccgtctggctgtcctacaaggtcgcgtctgccggcatttcctacaaggaccgcgagtggtgcttcaccggcgagcggaacaatcagatccttgaggaaaacatggaggtagaaatctggacgagggaaggggagaagaagaagctgagacccaagtggctggacgcccgcgtgtacgccgacccaatggccttaaaggacttcaaagagttcgcgtctggcagaaagtccattaccctggacatactcacggagatcgccaccctccccacgtacctgagctctaaggctaagctggccctcgataacatcgtaatgctgcacacgaccgagaaaggaggccgcgcctaccaacacgcgctgaacgagctacccgaatcacttgagaccctgatgctcgtggccctgctgggcgctatgaccgccgggatattcttatttttcatgcagggcaaggggatcggcaaactgagtatgggccttattgcgattgccgtggccagcgggctcttgtgggtagcggagatccagccgcagtggatcgcggcctccataatactggagttcttcctgatggtcctgctgatccccgagcccgaaaaacagcgcacacctcaggacaaccagctcatctacgtaatcctgaccatactgaccatcattggtcttatcgccgccaacgagatggggctgatcgagaagacgaagacggacttcggcttctaccaggtcaagccggagaccacaatactggatgtggacttgcgtcccgcgtcggcctggaccctgtacgcggtcgccacgaccatcctaacccccatgctccgacacaccatagaaaacactagcgccaacctgtcactggccgccatcgcgaaccaggccgccgtcctcatggggttgggcaaaggctggcccctgcatagaatggacctcggcgtcccgttacttgccatgggctgctactcccaagtgaaccccacgaccctcacggcctcccttgtcatgctgctcgtccactatgcgatcattgggcccggcctccaagccaaagccactcgcgaggcccagaagcgtaccgcggcaggcatcatgaagaatcccacagtggacgggataaccgtcatagacctcgagccaatcagctacgatcccaagttcgagaaacagctcggccaagtgatgctgttagttctctgtgtcgggcaactgttacttatgcggacgacatgggccctgtgcgaggtgttaaccctcgccactggccccgtaatgacgctgtgggagggtaatcccggccggttctggaacaccaccatagccgtatccaccgcgaatatcttccgcggcagctacctggccggcgccggactcgccttctccctgatcaaaaacgcacagacgccgcggcgcgggaccggcaccaccggggagacgctgggcgagaagtggaagcggcagctcaacagcctggacagaaaggaatttgaggagtacaagcggtccggcatcctggaagtggatcgcacagaggcgaagagcgccctcagagacgggaccaagatcaagtatgccgtgtcccgcggctcttctaagatccggtggatcgtggagagagggatgatcaagccaaaaggcaaggtagttgatctagggtgcggccggggcgggtggagctactacatggctaccttaaagaatgtcacagaagtgaaggggtacacgaaaggcggccccgggcacgaggaacccatcccgatggccacctacggttggaacttggtgaagcttcactccggcgtcgacgtgttctataagcccaccgagcaggtagacaccctgctatgcgacatcggtgagagctcgagcaacccgacgatcgaagagggtagaaccctgcgcgttttaaagatggttgagccctggctctccagcaagcccgaattctgcattaaggtgctgaatccttacatgcccacggtaatcgaggagctggagaagctccagcgtcgccacggggggagcctggttcgatgccccctctcccgtaatagcacccatgagatgtactgggttagcggcgcgtcagggaacatcgtgtcctctgtgaatacgataagtaagatgctgctcaaccggttcaccacccgccaccgcaagccaacctacgagaaggacgtcgatctgggcgcagggacccggagtgtatccaccgaaaccgaaaagcccgacatgaccgtgatcggccgtcgcctgcagcgtctccgcgaggagcataaggagacgtggcattacgaccaggaaaacccctaccgcacctgggcctaccatgggagctacgaagccccctccactggaagcgcgagtagcatggtcaacggcgtggtcaagctgcttaccaagccttgggatgttatcccaatggttacgcaactcgccatgaccgacaccacccccttcgggcagcagagagtgttcaaggagaaggtggacacgagaaccccacaacccaagcccggcacccgtatgattatgaccacgaccgccaactggctgtgggctttgctcgggaagaagaagtcccccaggctgtgcacgcgcgaggagttcatcagcaaggtgaggtctaatgcagcgataggcgcggtgttccaggaagagcagggctggaccagcgcctccgaggccgtcaacgacagccggttctgggagctggttgacaaggagagagccttgcatcaggaaggcaagtgtgagagctgtgtctacaacatgatgggaaaacgcgagaagaaactgggggagttcggacgcgcgaagggtagtcgtgctatatggtacatgtggctaggtgcccgcttcctcgagttcgaggccctggggtttctgaacgaagatcattggttcagccgggaaaattcatggtctggcgtcgagggtgaggggttgcaccgactcggctacatactggaggacattgacaaaaaggacggagacctcatctatgccgacgatacggcaggctgggacaccaggataaccgaggacgacctcctgaacgaggagctcataaccgagcagatggccccgcaccataagacgctggccaaggccatattcaagttaacctaccagaacaaggtggtgaaagtcttgcgacccacacccaaaggcgcggtaatggacataatcagccgtaaggaccagcgcggaagcggccaagtgggtacctacggacttaacacttttacgaacatggaggtccagctgatccgccagatggaagctgagggcgtcattacccaggatgacatgcaaaacccaaagggcctgaaggagagagtggagaagtggctgaaggaatgcggcgtcgaccggttgaagcgcatggccatatccggggatgactgcgtggtgaaaccactagatgagcggttctctacctccctgctgtttctcaacgacatgggcaaggtccgcaaggacataccccagtgggagccttctaagggctggaagaactggcaggaggtgcctttctgctcccatcacttccacaagatcttcatgaaggacggtcggagcctagtggtaccttgccgcaatcaggacgagctgattgggagggcccggatctcccaaggtgccggctggtctctccgggagacggcgtgcctcgggaaggcgtacgcccagatgtggtccctgatgtacttccaccgacgcgacctcagactggcaagcatggccatttgcagcgccgtgcccacagaatggttccccaccagccgcaccacgtggtccatccatgcccaccaccagtggatgacgactgaagacatgctcaaggtgtggaatcgggtctggatcgaggacaaccccaatatgacagacaagaccccggtgcactcctgggaagatatcccctacctcggcaagcgcgaggacctgtggtgcggaagcttaatcggcctgtccagtcgggccacgtgggccaagaacatccacacagcaatcacccaggtgcgcaacctgatcgggaaggaggagtacgtcgactatatgcccgcaatgaaacggtactccgcacccttcgagtctgagggtgtcttgtga

SEQ ID NO: 26289 - RNA, 9867 nt, synthetic construct
  misc_feature 1..9867: note = derived and/or modified CDS sequence (opt11) from DENV-4__JF262783__SS-prME
  source 1..9867: mol_type = other RNA
agtaccgttactctgctttgtctcatacctaccgtgatggccttccatttaagcacccgcgacggtgaaccgctcatgattgttgccaagcacgagcgtggacgacccctgctgtttaaaactaccgagggcataaataagtgcaccctaatcgccatggatctgggggagatgtgcgaggacactgtgatgtacaaatgcccgctgcttgtgaacaccgaaccagaggatatcgactgttggtgcaaccttacaagtacatgggtgatgtatggtacctgtacccagagtggggagaggcgacgggaaaagagatcagttgcgctgacgccgcactccggtatgggcctcgagacgagggccgaaacctggatgagctccgagggggcgtggaagcatgcgcaaagagtggagagctggattctgaggaaccccggtttcgcgctcttggccggtttcatggcctatatgatcgggcaaacggggatccagcgcactgttttcttcgtgctaatgatgctagtggccccttcatacggcatgcggtgcgtgggcgtggggaaccgcgactttgtcgaaggcgtaagcggtggtgcgtgggtggacctcgtcctggaacacggcgggtgcgttacgacgatggcccagggcaaaccaacattagactttgagctcatcaagaccacggctaaggaagtgaccctgcttcggacctactgcatcgaggcatccatttcgaatattaccaccgccacgcgctgccctacccagggtgaaccctatttgaaggaggagcaggatcagcagtatatctgccgaagagacgtcgtggaccggggctggggtaacggctgcggactgttcggaaaaggcggggtagtgacttgcgcgaagtttctgtgctccgggaagatcactgggaatctcgtgcaaatcgagaacctggagtacaccgtggtggtgacggtacacaacggcgatacgcacgtagtggggaaggatacgagcaatcacggggtcaccgccacaatcacgccccggtcccccagcgtcgaagttaagctaccagactacggcgaactaacattagactgtgagccacgctccgggatagacttcaacgagatgatcctgatgaagatgaagaagaagacctggctcgtccacaagcagtggtttctggacctccccttaccttggaccgccggtgcggacacctctgaggtgcagtggaattacaaggagcgcatggtgacctttaaggtccctcatgccaagaggcaagacgtgaccgtgttggggtcccaggagggggcgatgcacagcgctctaaccggcgccaccgaagtcgacagcggggacggcaaccacatgttcgcagggcacctcaagtgcaaggtccgaatggagaagctccgcataaaaggcatgtcctatacaatgtgcagcggcaagttttcgatcgacaaggagatggctgagacgcaacatgggactactgtcgtcaaggtgaaatatgagggcgcgggagccccctgcaaagtccccatcgaaatccgggacgtgaataaggagaaggtggtaggccgtatcatcagctccacccccttcgccgagaacaccaactcagtcaccaatatcgaactggaaccacccttcggcgactcctacatcgtgatcggcgtgggcgacagcgcactcaccctgcactggttccggaagggttccagcatcggcaagatgttcgagtccacctaccgcggggcaaaacgcatggccattctgggcgagacagcctgggacttcggcagtgttggaggtctcttcacctccttaggcaaagccgtgcaccaggtgtttgggagcgtctacacgaccatgttcggaggcgtatcatggatggtgcgcattctgataggtctcctagttctgtggatcggaaccaatagtcggaatacgtctatggccatgacctgtatcgctatcggaggtataaccctgttccttggttttacggtccatgcggacatggggtgcgcagtgtcctggtccggcaaggagcttaagtgcggaagcggcatctttgtcatcgacaacgtgcacacttggaccgagcaatataaattccaacccgagagtccggcccgcctagccagtgccattctcaacgcccacaaggatggcgtatgtgggatccggtccacaaccaggctggagaatgtcatgtggaagcagataaccaacgagttaaactacgtgttatgggagggcgggcacgatctgacagttgtggccggtgacgtcaaaggcgtgctgacaaaggggaagcgggccctcacgccgccagtcaacgacctgaagtattcttggaagacctgggggaaagccaagatctttacgcccgaggcgcgcaacagcacttttctgatcgacgggcccgacacatcggagtgccctaacgaacggcgcgcgtggaacttcctcgaggtcgaagactatggcttcggtatgttcgcaactaacatatggatgaagttccgggaggggagttccgaggtatgtgaccaccgccttatgtctgccgccatcaaagaccagaaggctgtccacgcggacatgggctattggatcgaatccagcaagaaccagacatggcagatcgagaaggcctccctgatcgaggtgaaaacctgtctctggcctaagacgcacacgttatggagcaatgaggtactggagtcccagatgctaataccaaaagcctacgcggggccgtttagtcagcacaactatcggcagggctacgccacccaaacgatcgggccgtggcatctgggcaagctggagatcgatttcggggagtgccccggcaccactgtcaccatccaggaagactgcaaccaccgtggcccatctctacggactaccacggcaagtggcaagttagtgacccagtggtgctgccgctcatgtaccatgccgccacttcgctttctgggcgaggatgggtgctggtacggaatggagatccggcccctgagtgagaaagaagagaacatggtcaaaagccaggtctcagccgggcaaggcacttccgagacgttctctatgggcctgctttgtctaaccctgtttgtggaggaatgtctccgccgacgggtcaccagaaaacacatgatcctcgtggtggtcaccacgctgtgtgccatcatcctcgggggcctgacctggatggatttattacgcgcgctgataatgctaggggacaccatgtctggccggatgggagggcagatacacctaaccatcatggccgtgttcaagatgtctcccggatatgttttgggcgtattccttcgcaaattgaccagccgagagaccgcactgatcgtgatcggtatggctatgactacggtgctgagcatcccgcacgatctgatggaatttatcgacggaatctcactgggcctgatattgttaaagatggtcgcccacttcgacaatactcaagtgggcaccctggcactctctcttactttcataaggagcaccatgcccctggtgatggcctggcggacgatcatggccgtcctcttcgtggttaccctgatacccctgtgcagaacctcctgtctccaaaagcaaagccactgggtagaaatcaccgccctgatcttgggagcccaggcgctgcccgtttacctgatgaccttgatgaaaggcgcgtcgaagcgtagctggccgctcaacgagggaatcatggcggtgggcctggtctccttgctcgggagcgccttgcttaagaatgatgttcccctcgcgggccctatggtggccggcgggctgctgctagcagcctatgtaatgtccggcagctccgccgacctgagcttggagaaggccgccaacgttcagtgggacgaaatggccgacatcactgggagctcccccattatcgaggtgaagcaggatgaggatgggagcttctccataagagacgtcgaagagaccaacatgatcaccttgctggtgaagctggccctcatcacggtgagtggcctatacccgctggctatccccgtcaccatggccctctggtacatgtggcaggtcaagacccagcggtccggcgccctatgggacgtgccaagccccgcggcggcccaaaaggctacccttacggagggtgtctaccggattatgcagaggggcctcttcggaaaaacccaagtgggggttgggatccatatggagggcgtgttccataccatgtggcatgtaacccgggggagcgtgatatgccacgagacgggccgcctggagccaagctgggcagatgtcagaaatgatatgatctcctacgggggaggttggagactaggtgataagtgggacaaggaggaggacgtccaggttcttgcaatcgagcccggtaagaacccaaagcacgtccagacgaaaccgggtctgttcaagacactgaccggcgagatcggtgccgtgaccttggacttcaagccaggcacgagtgggtccccgatcatcaataagaagggccgcgtgatagggctatacggtaacggcattgtgaccaagtctggcgactacgtgagtgccatcacgcaggcggaacggatcggggaacctgactacgaggtcgacgaggatatattccggaaaaagcgtttaaccgttatggacctccacccgggggccggtaagacgaagaggatactgcccagcatcgtcagggaagcactgaaacgacgcctacggacactcattctcgcacccacccgcgtggtcgctgccgagatggaggaggcactgcggggactacccatccgctaccaaacgccggcggtcaaaagcgaacacacggggcgggaaatcgttgacctgatgtgccacgccaccttcaccacccgtttactcagctccaccagagtccctaattacaacctgatcgtgatggacgaagctcacttcaccgacccttccagcgttgccgcccgtggctacatcagcacccgggtggagatgggggaagccgcggccatctttatgaccgccacgccccctggcgccacagacccattcccccagtcgaactctcccattgaggatatagagcgcgaaatccctgagcggagctggaacaccggatttgactggatcacagattaccagggaaagacggtctggttcgtacccagcatcaaggccggcaacgacatcgccaactgcttgcgcaagagcgggaagaaggtaatccagctctccagaaagacttttgacaccgagtacccgaaaaccaagctgaccgactgggactttgtggtcacgaccgacatatctgaaatgggcgcgaactttcgcgcccgccgggtgatcgacccccgtcgctgcctcaagccagttatccttaccgacgggccggagcgcgtcatcctggccggccccatcccggtaacgccggcttccgcggcccagcggcgcgggcggataggccgcaatcctgcacaagaggatgaccaatacgtgttttctggcgaccccctaaagaatgatgaggaccacgcccactggacggaagctaagatgctcttggacaacatctacacgcccgaagggatcattccgaccctgttcgggcctgaacgtgagaaaatccaggccatcgacggcgagttccgcctccggggcgagcagcgcaagacgttcgtcgagttaatgagacgtggcgatctgccggtgtggctcagttacaaagtggcctcagccgggatctcctacaaggaccgcgagtggtgctttaccggcgaacgcaacaaccagatactggaggaaaacatggaagtggagatttggaccagggaaggggagaaaaagaaattacgcccgaagtggctcgacgcgcgagtatatgccgacccgatggcgctgaaggatttcaaggagttcgccagcggacgcaagtccattaccctagacattctaacagagatcgcatctctacccacctacctctccagtagggccaaattggccctggacaacatagtgatgctgcataccaccgagagagggggccgcgcgtatcaacacgccctcaacgagctgccagagagtctcgagacattaatgctcgtcgccctgctcggcgccatgacggcggggatcttcctattcttcatgcaggggaagggaatcggaaagctgagcatgggtcttatggcaatcgccgtagcctccggcctgctgtgggtcgccgagatacagccgcaatggatcgcggcaagcatcatacttgaatttttcctgatggcccttctcattcccgaacctgagaaacagcggacacctcaggacaaccagttaatctacgttatcctaacaatactcactatcatcgggcttatcgcagcaaacgagatggggctgattgaaaagacgaagaccgactttggcttctaccaggtgaaaaccgagaccacgattctggacgtagacttacgacctgcgagcgcttggacactatatgcagtcgccaccaccatcctcacgccgatgctgcggcacaccatcgagaacacgtcagccaatctgagcctcgccgccatcgccaaccaggcggccgttctaatgggcctggggaaagggtggcccctacaccgcatggacctgggcgttccgttattagctatgggctgctattcccaagtcaaccctacaacgctgacagcatccctagtaatgctctcagtgcactacgccatcatcgggccaggtcttcaggcaaaggcgacccgagaggcccagaaacgtactgccgcggggataatgaagaaccccacggtagacgggatcacggtgattgacctcgagcccattagctacgacccgaaatttgagaaacagctcggccaggtgatgctacttgcactatgcgccgggcaacttctattaatgagaacgacctgggccttctgcgaggtactgacgctggccaccggtcccattctcaccctgtgggaggggaaccccggccggttttggaacaccacgatagccgtgtccaccgccaatatctttagggggagctacctggcaggcgccggcctggccttctccctgatcaagaacgcccagactccccgccggggcaccggtacgaccggagagaccttaggtgagaagtggaaacgccagttgaactctctggaccggaaggagttcgaggagtacaagcgctcagggatcctcgaggttgaccggaccgaggccaagagtgcgttaaaagacggctccaagatcaagcacgccgtgtcgcgcggttccagcaagatccggtggattgtggaacgcggtatggtcaagccgaagggcaaggtcgtggacctggggtgcgggcgcggcgggtggtcctactacatggccacgctcaaaaacgtaactgaagtaaaggggtacactaagggcgggcccggccatgaggagccgattcccatggccacctacggctggaacctcgtgaaacttcacagcggggttgacgtcttctacaaaccgaccgagcaggtcgacacgctcctctgcgacatcggcgagtccagcagcaaccccacgatcgaagagggacgtacattacgcgtgctaaagatggtcgaaccatggctctcctcaaaaccggagttttgcatcaaggtattgaacccatacatgcccaccgtaatagaggaactagaaaaactccagcggaagcacgggggcagtttggtccgatgcccgcttagccgtaatagcacgcacgagatgtactgggtgtcaggcgcatccggcaatatcgtcagctcagttaataccacctctaaaatgctgcttaaccgcttcaccacacgccacagaaagcccacgtacgagaaggacgtgaacctgggggccggtacccgctccgttagcaccgaaaccgaaaagccggacatgacaataatcggacgcagactccagcggctccgggaggagcacaaggaaacctggcactacgatcaggaaaacccgtacaggacatgggcgtaccatgggtcctatgaggccccaagtacgggctccgcctcatcaatggtcaacggggttgtgaagctgctaactaagccgtgggacgtgatacccatggttacacagctagcgatgaccgatacgacgcccttcggacagcagagggtgttcaaggagaaggtggacacccgcacaccgcagccgaagcctggaacgagaatggtcatgaccaccaccgcaaactggctgtgggccttgctcgggaaaaagaagtcgccgcgcttatgcactcgggaggagttcatctccaaggttcgcagtaacgccgccatcggcgcggtgttccaagaggagcaggggtggaccagcgcctccgaagccgtcaacgactcacgattttgggagctggtcgataaggagcgcgccctccaccaggaaggcaagtgtgagagttgtgtatacaacatgatggggaaacgtgaaaagaaattgggcgagttcggtcgggccaagggctcgcgtgctatctggtatatgtggcttggcgcgcggttcctggagttcgaggccctagggtttctgaatgaggaccactggtttggccgcgagaactcgtggtctggggtggagggagaaggactccaccggttgggatacatcttggaagacatagataagaaggacggggaccttatctatgccgacgacaccgcgggatgggacacccgtattacggaggacgacttactgaacgaggaactcatcacggagcagatggctccccaccatcgaatcctggccaaagccatcttcaaactgacctatcaaaacaaggtcgttaaggtgctccgcccgacgcctaaaggagccgtcatggacataatcagtcggaaggaccagcgcggcagtggacaggtgggcacttacgggctgaacacctttaccaacatggaggtgcaattaatcagacaaatggaggcggaaggcgtcatcacccaggacgacatgcagaatccaaaggggcttaaggagcgcgtagagaagtggttaaaggagtgcggcgtggaccggttaaaacgcatggcgatctctggcgacgactgtgtagtgaagcccctcgacgaacggttctcgaccagccttctctttctcaacgacatggggaaggtgagaaaggacatcccgcagtgggagccttcaaagggttggaagaactggcaggaggttccgttctgctcgcaccacttccacaagatctttatgaaagacgggcggagcctcgtcgtgccttgccgcaaccaggacgagctgataggacgggcccgcatttcccaaggcgccggctggagcttacgggagacggcctgcctcggaaaggcctacgcacagatgtggtccctcatgtacttccacagacgcgacttacggctggccagcatggccatctgctcggccgtccccactgagtggtttcccaccagtcgaaccacgtggagcatccatgcgcaccaccagtggatgaccactgaagacatgctcaaggtgtggaaccgagtgtggatcgaggataaccccaatatgacagacaagacgccagtacactcctgggaggacatcccttaccttggaaagagagaggacctgtggtgcggcagtctgatcgggctctcctctagagccacctgggccaagaacatccacacggcaataacccaggtgcgcaaccttataggcaaggaggagtacgtggactacatgcccgtcatgaagcggtattccgcgccgttcgaaagcgaaggagtgctgtga

SEQ ID NO: 26290 - RNA, 9867 nt, synthetic construct
  misc_feature 1..9867: note = derived and/or modified CDS sequence (opt11) from DENV-4__KU513441__SS-prME
  source 1..9867: mol_type = other RNA
agcaccattaccctattgtgcctgatccccaccgtgatggccttccacctgtccacgcgcgatggcgagccgttgatgatagtcgccaaacacgagcggggcagacccctgctgttcaagacgaccgaggggatcaacaaatgcactcttatcgcgatggatctgggggagatgtgcgaggacaccgtgacctacaagtgtcccctgctcgtgaataccgagcccgaggacatagactgctggtgcaacctgacgagcacctgggtaatgtacggaacctgcacccagtccggggagcggcgccgggagaaacgcagcgttgcactgacgccgcattccggtatgggcctcgaaacccgggcagagacctggatgagctccgagggggcttggaaacacgcacaacgcgtggaaagctggattctgcggaacccgggcttcgccctgcttgcagggttcatggcatacatgatcggccagaccgggatacaacgcacggtctttttcgtgctgatgatgctggtggctccctcctacggtatgcggtgcgtcggcgttggaaacagagacttcgtggagggcgtcagcgggggtgcttgggtggacttggtgctagagcacggcgggtgcgtcaccaccatggctcagggcaaacccaccctggacttcgaactcactaagaccaccgccaaggaggtggccctgctgcgaacctactgcatcgaggcactcatctccaacataaccactgccacccgatgcccgactcagggggagccctacctgaaggaggagcaggatcagcagtacatctgccggcgcgacgttgtcgaccgggggtggggcaacggatgcggcttgttcgggaagggcggggtggtaacgtgcgccaagttcagctgctccggcaagatcacgggtaatctagtccagattgagaacctagagtacaccgtggttgtcaccgtgcataatggggacacccacgccgtcggtaacgacacaagcaatcacggggtcacggccaccatcacaccccgctccccgagcgtagaggtcaaattgccggactatggcgagctcaccctagactgcgagccccggtccgggatcgactttaacgagatgattctgatgaaaatgaaaaagaaaacctggctcgtccacaagcagtggttcctggacctgcccttaccgtggaccactggagccgatacaagcgaagtccactggaactacaaggaacgcatggttaccttcaaggtgccgcacgcgaaacggcaggatgttaccgtcctgggatcccaggagggcgccatgcactccgccctagccggtgcgaccgaggtggatagcggggatggcaaccacatgttcgcaggtcacctaaagtgcaaggttcggatggagaagctgcgcatcaagggcatgtcctacacgatgtgctccgggaagttcagtatcgacaaggagatggccgagacgcagcacggcaccaccgtcgtcaaggttaagtacgagggcgccggggccccctgtaaggtccccattgagatccgggacgtgaacaaggagagggtggtgggaagagtaatcagcgccacgcccctggcggagaacacaaattccgtgaccaacatcgagctcgagccgcccttcggagacagctacatcgtcatcggcgtgggcaactccgccctaaccttacactggttccgcaagggcagctccatcggcaaaatgttcgagagcacttaccgcggggccaagagaatggccatcctaggtgagaccgcgtgggacttcggctccgttggcggcttattcaccagcctggggaaagccgtccaccaggtgttcggttccgtgtacaccacgatgttcgggggagtcagctggatgatcagaatacttattggattcctggtgctttggatcggtaccaattcacgcaatacgagcatggccatgacttgcattgcggtgggtggaatcacgctatttcttggcttcaccgtgcaggccgacatggggtgcgtggtgtcctggagcggccgggaactcaagtgcgggtccggcatcttcgtggtggacaacgtccatacgtggaccgagcagtataagttccagcccgagagccccgcgcgccttgcctcggcgatcctcaacgcccacaaggacggtgtctgcgggatccggtccaccacccgtctggagaacgtgatgtggaagcagatcaccaacgagctgaactacgtgctatgggaaggagggcacgacctcactgtcgtggccggcgacgtgaagggcgtactaacgaaggggaagcgggcgctcaccccaccggcgtcggacctgaagtacagctggaagacctggggcaaggccaagatcttcacaccggaggcccgcaacagcacgtttctgatcgacgggcccgatacctccgaatgccccaacgagcggcgagcctggaacagcttcgaggtggaggattacggctttgggatgttcaccaccaacatatggatgaagttccgggagggctccagcgaagtgtgcgaccacaggctcatgtccgcggccatcaaggaccagaaggccgtccacgccgacatgggctactggatcgagtcgtctaagaaccagacgtggcagatcgagcgggcgtcactgatcgaggtgaagacctgcctctggccgaagacccacacactctggtccaacggggtactggagagtcagatgctgatccccaagtcctatgccggaccgttcagtcagcacaactaccgccaagggtacgcgacacaaacagtcggtccctggcacttggggaaactggagatcgacttcggcgagtgccccggcaccaccgtgaccattcaggagaactgcgaccaccgcgggccctccctgcggacgaccactgccagcggcaagttggtcacccagtggtgctgccgcagctgcacaatgccacccttgcggttcctgggtgaggacggttgctggtacgggatggaaatcaggcccttgtccgaaaaggaggaaaacatggtcaagagccaggtcaccgccggacagggaaccagcgagacctttagtatggggctgctttgcctcacgctattcgtcgaggagtgcttacggagacgggtgaccaggaagcacatgatcctcgcggtggtcatcacactgtgcgccataatcttagggggtctcacctggatggacttactgagggcccttataatgctgggcgacacgatgagcggtaggatcgggggccagactcacctggccatcatcgccgttttcaaaatgagccccgggtatgtgctcggcgtcttccttcgtaagttgacctcccgcgagaccgcgctcatggtgatcgggatggccatgacgactaccctaagcatcccgcacgacttaatggagcttatagatggcatctccctcggtctaatcttgctcaagatcgtgacgcagttcgataacacacaggtagggaccttggccctctccttaacattcatcaggtcaaccatgagcctggtgatggcctggcgcacgatcatggccgtactcttcgtcgtgaccctgatccccctctgtcggacatcctgcctccaaaagcagagccactgggtggagatcaccgcgctaatactgggtgcgcaggccttgccggtttacctgatgacgttgatgaagggggcctcccgccggtcttggcccctaaacgagggcatcatggcggtggggctggtgtccctgctcggctcggccttgctgaagaacgatgtgccgttagccggacccatggtggccggaggcttgctgctcgcagcgtacgtgatgagtggcagctcagcagacttatccctggagaaggccgcaaacgtccaatgggacgagatggcagacatcaccggcagctcccccatcatcgaggttaagcaagacgaggacgggagcttttccatccgcgacgtggaggagaccaacatgataaccttgctggtgaagctggcactcatcacggtttccggcctgtaccccctggctatccccataaccatgacactctggtacatgtggcaagtcaagacccagcggtccggcgccctctgggacgttccttctccagccgccacccagaaagcggccttatccgagggggtgtacagaattatgcagcggggcctcttcggaaagactcaggtgggcgtcgggatccacatggagggcgtgttccacaccatgtggcatgtgaccaggggctctgtcatttgccatgagaccggtcgcctggagccctcatgggcggacgttcggaacgacatgatctcttacggtgggggctggcggctgggcgacaagtgggacaaagaggaggacgtgcaggtcctcgcaattgaaccgggaaagaatcccaaacacgtgcagacgaagcccggcttgtttaagacccttactggggagattggcgccgtgaccctcgacttcaaacccgggacctccggcagcccgatcatcaaccggaagggtaaggtcatcggcctgtacggcaacggcgtggtgacaaagtcaggcgactacgtctcagcgatcacccaagccgagcgcatcggagagcccgattacgaggtcgacgaggacatcttccgaaagaagcgcctgaccatcatggatctccacccgggcgccggtaaaacgaagcggatcctgccgtccatcgttcgcgaggctctgaagcgccgcctgcggaccctcatcctggcgcctaccagagtagtggcggcggaaatggaggaggcgctgcgtgggctccccatccgctaccagacccctgccgtaaagagcgagcatacgggccgggagattgtggatctgatgtgccacgcgaccttcaccacccggctcttgtccagcacgcgcgtcccaaactacaatctgatcgtgatggacgaagcccacttcaccgatcccagctccgtcgccgcacgcgggtacatcagtacccgggtggagatgggagaggccgcggcgatcttcatgacagccacgccacccggggccaccgatcctttcccgcagtccaattcgcccatcgaggacatagagcgggagatccccgaacgctcctggaacactggcttcgactggattaccgactaccaaggcaagacggtctggttcgtgccgagcattaaggccgggaacgatatcgcgaactgcctgcggaagtccggcaaaaaggtgatccagctcagccgcaagacattcgacaccgagtaccccaagaccaagctgacggattgggactttgtagtgactaccgatatatccgagatgggagctaacttccgggccggccgcgtgatcgacccccggcgctgcctgaaacccgttatcctcaccgacggcccagagagggtcatcctggcgggccccatccctgtgacgcccgcgagcgcagctcagcgccgcggccggatagggcggaacccggcccaggaagacgaccagtacgtcttctccggggaccctcttaagaacgacgaggatcatgcccactggaccgaagctaagatgctactggacaacatctacacccccgaggggatcatccccacgctgttcggcccggagcgtgagaaaacgcaggccatcgacggcgagttccgattacgtggggaacagcggaagaccttcgtagagctaatgcgccggggcgacctgccggtgtggctctcatacaaggtcgcttccgccgggatcagctacaaagatcgcgagtggtgcttcaccggcgagcggaacaaccaaatcttggaggaaaacatggaggtagagatttggacgcgcgagggtgagaagaagaaactgcggccgaagtggctcgacgccagagtctacgcggaccccatggccctgaaggacttcaaggagttcgccagtggccgcaagagcatcaccttggacatcttgacggaaatagcatcccttccgacctacctgagctcccgggccaaactcgcgctggacaatatcgtcatgctgcataccacagagcgcgggggtcgggcgtaccagcacgctctaaacgaactgcccgagagcctggaaacgctcatgctggtggccctgctcggagcgatgaccgccgggatcttcctgttcttcatgcagggcaaggggatcgggaaacttagcatgggcctcatcaccatagccgtggcctctgggctgctgtgggtagccgagatccagccacagtggatcgcggccagcatcatcctcgagttcttcttgatggtgctgctcatcccagagcccgagaagcagcgcacaccccaggataaccagcttatctacgtgattctgactatcctcaccatcatcggccttatcgccgcaaacgagatggggctgatcgagaagaccaagaccgacttcggcttctaccaggtcaagacggagaccactattctcgacgttgacctcagacccgcctccgcgtggaccctctatgccgttgcgacgacgatcttaaccccaatgctgcgccacaccatcgagaacacgtccgccaacttatcccttgccgcgattgccaaccaggccgccgtccttatgggcctaggcaaagggtggcccttgcatcgtatggacctgggggtacccttgcttgcaatgggctgctacagccaggtcaaccccaccactttaaccgcaagcctggtaatgctactggtgcattatgccatcatcgggccgggcctgcaggctaaagccacgcgcgaggctcagaagcggaccgcagccggcatcatgaaaaaccccaccgtggacggaatcacagtcatcgacctcgaacccatcagctacgatcctaagttcgagaagcagctgggtcaggtgatgttactcgtcctctgcgccgggcagctgttattaatgcgcacgacctgggcattctgtgaggtcttaaccctcgcgacaggcccgatccttacattgtgggagggtaaccccggccgattttggaacacaaccatcgctgtgtccaccgccaatatcttcagaggaagctacttagccggtgccggcctggcatttagtctgatcaaaaacgcccagacgccacgtcgcgggaccggcaccgccggggagacattaggggagaagtggaaacggcagctgaacagcctcgaccgcaaggagtttgaggagtacaagcgatccggcatcctggaagtggaccgcaccgaagccaagagcgcactgaaggacgggtccaagatcaagcatgcggtcagccggggctccagcaagatccgctggatcgtggaacgcgggatggtgaaacccaagggcaaggtggtggacctcgggtgcgggcggggcggatggtcttactatatggccacgctcaagaatgtcaccgaggtcaaaggctacaccaaaggagggccggggcacgaggagcccattcccatggccacctacgggtggaacctggttaagctgcacagtggggtagatgtcttttacaagcctacggaacaggtggacaccttgctgtgcgacatcggggagagctcctctaatcctacaatcgaggagggccgaaccctccgagtgctcaagatggtcgaaccctggttatccagcaaacccgagttttgcatcaaagtgctgaatccgtatatgcctacggtaatagaggagctggagaagctccagcgcaagcacggtgggaacctggtccgttgccccctgtcccgcaacagcacccacgagatgtactgggtgtccggcgccagcggaaacatcgtctccagcgtcaacaccacctccaaaatgctcctgaaccggttcaccacccgccaccggaagcccacctacgagaaggatgttgacctgggagcggggaccagaagcgtctcaacagagatcgagaagcccgacatgaccatcatcggccggcgcctccagagactgcaggaggaacacaaggagacctggcactacgaccaggagaatccgtaccggacctgggcctaccacggaagctacgaggcgccctcgaccgggagcgcctccagcatggtgaacggggtagtgaaactgctgaccaaaccctgggacgtcatcccaatggtgacgcagctggcaatgaccgatacgaccccttttgggcagcagagagtcttcaaggagaaggtagataccaggactccccagccgaagccgggcacgaggatggtcatgaccacgaccgcgaactggctttgggccctcctggggaagaagaagaacccccgcctgtgcactcgagaggagttcatctctaaagtccgcagcaacgccgccattggcgccgtgttccaggaagaacaagggtggacgagtgcgtccgaggccgtgaacgactcgcggttctgggagctagtcgacaaggaaagggcgctacaccaggagggcaagtgtgaatcctgcgtgtacaacatgatgggcaagcgcgagaagaaattgggcgagttcggccgggccaaagggtcgcgcgcaatttggtacatgtggctcggggcgcgttttcttgagttcgaggccctgggattcctcaacgaggaccactggttcggcagagagaactcctggagcggcgttgagggggagggcctgcaccggctggggtacatcctggaggagatcgataagaaggacggcgacctgatgtacgcggacgacaccgccggctgggacacccgcatcacggaggacgacctgcagaacgaggagctgatcaccgagcagatggcgccccaccacaagatcctggccaaggccatcttcaagctgacctaccaaaacaaggtcgttaaggtgctccggcccaccccacgcggggccgtcatggacatcatcagtcgtaaagatcagcgcggcagcgggcaggttggcacgtacggcttaaacacgttcaccaacatggaggtccagctgatccggcagatggaggccgagggcgtcatcacccaagacgacatgcagaaccccaaggggctcaaagagcgtgtggagaaatggcttcgggagtgcggggtcgaccgcctgaagcggatggcgatctccggggacgactgcgtcgtgaagccccttgacgagcgcttcgggaccagcctgctgttcctcaatgatatgggtaaggtgcggaaggacatcccccagtgggaaccgtccaagggttggaaaaattggcaggaggttcccttttgcagccatcatttccacaagatcttcatgaaggacggccgctccctggtagtgccctgccggaaccaggacgagctgattggccgtgcccgcataagtcagggggcaggctggtccctccgtgagacggcctgtttggggaaggcctacgcgcagatgtggtcgctaatgtatttccaccgccgggacctgcgcctagcctccatggccatctgttcagcggtcccaactgaatggttcccgaccagccgaaccacgtggagcatccacgcccatcaccagtggatgacgaccgaggacatgctgaaagtttggaaccgcgtgtggatcgaggataaccccaacatgatcgataagaccccggtccacagttgggaggacatcccctacctcggcaagcgcgaggatctgtggtgcgggtccctgatcggcctctcatcccgagcgacgtgggccaagaacatccacaccgccatcacccaggtgcggaacctgatcggcaaggaagaatacgtggactacatgagcgtcatgaagaggtacagtgcccctagcgagtccgagggggtgctttga

SEQ ID NO: 26291 - RNA, 9867 nt, synthetic construct
  misc_feature 1..9867: note = derived and/or modified CDS sequence (opt11) from DENV-4__KC762694__SS-prME
  source 1..9867: mol_type = other RNA
agcaccatgaccctcctctgtctgatccctaccgttatggcgttccacttgtccacccgggacggggagccgctcatgatagtggccaagcacgagcgggggcgccccctgctgttcaagaccacggagggtatcaacaagtgcacgctcatcgcgatggacctgggggagatgtgcgaggacaccgtgacctacaagtgccccttactcgtgaacacggaacctgaggacattgattgttggtgcaaccttacgagcacttgggtgatgtacgggacctgcacgcagtccggggagcggaggcgggagaagcgcagcgtggccctgactccgcattctggcatgggcctcgagacccgtgcagagacctggatgagctccgagggggcctggaagcatgcccagagagtggaatcttggatcctgaggaatcccggcttcgcgctgctcgccgggttcatggcctacatgatcggtcagaccggcatccagcgcaccgtcttctttgtgctgatgatgctggtggccccctcctacggcatgcggtgcgtcggcgtcgggaatagggacttcgtggagggcgtgtcagggggcgcgtgggtggacctggtgcttgagcatggcgggtgcgtcacgaccatggcccaggggaagccgacgctcgattttgaactaacgaagaccacagcgaaggaggtggcgctgctgcggacctattgtatcgaggcttccatcagcaacatcacgaccgctacccgctgcccgacccagggggagccctacctcaaggaggaacaggaccagcagtatatctgccggcgcgatgttgtcgaccggggctggggcaacggctgcggactcttcgggaagggcggcgtggtgacttgtgccaagttcctgtgttcgggcaagataaccggcaacctcgtacagatcgagaacctggaatacaccgttgtagtcaccgtgcacaacggcgacacacacgctgtgggcaacgacactagcaatcacggggtcaccgccaccataacgccccgctcccccagcgtggaggttaaacttccggactacggcgagctcaccttggactgtgagccgcggagcggaatcgattttaacgagatgattctgatgaagatgaagaagaagacatggctcgtgcacaaacagtggttccttgacctgcccctcccctggacggcaggcgcggacactagcgaggtgcactggaactacaaggagcgcatggttacgttcaaggttccgcacgcgaagcggcaggacgtgaccgtcttaggatcccaagagggcgctatgcacagcgccttagccggcgcaaccgaggtggactcaggggacggcaaccacatgtttgccggacacttaaagtgcaaagtccgcatggagaaactgcgcattaaaggcatgtcttataccatgtgttcaggcaagttctccatcgacaaggagatggctgaaacgcagcatgggaccaccgttgtgaaggtaaagtatgaaggtgctggggcgccctgcaaggtccccatagaaatccgggacgtgaataaagagaaagtggtcggccgcataatcagctccacacctttcgcggagaacacgaacagcgtaacgaacatcgagctggagccgccctttggggactcgtatatcgtgatcggcgtcggagactctgctctcacattacactggttccggaagggttcctcgatcggcaagatgttcgagtccacctaccgaggggccaagcggatggcaatcctgggagagactgcgtgggacttcgggagtgtgggcggactctttacctccctgggaaaggccgtgcaccaggttttcggaagcgtatacacaaccatgttcggaggggtatcctggatgatccgcatcctgatcggattcctcgtcctgtggatcggcacaaacagccgcaacacctccatggcaatgacgtgcatcgctgtgggcgggataacgctgttcctcggtttcacggtgcaggcagacatgggatgtgtcgtatcatggaacggcaaggagctcaagtgcgggtccggcatattcgtggtcgacaacgtacatacgtggactgagcagtacaagttccaacccgaaagccccgcgcgcctggccagcgcaatcctgaacgcccacaaggacggagtgtgcgggatccggagcactagcagactcgagaacgttatgtggaagcagatcacgaacgagctgaattacgtgttatgggagggcgggcatgatctcaccgtggtcgccggcgacgtgaagggcgtgctcaccaaggggaagcgtgcgctaacaccacccgtcaacgacttaaagtactcctggaagacgtgggggaaggctaaaatcttcactcccgaggcacgcaacagtaccttcttaatcgacgggccagacacctccgagtgcccgaatgaacggcgagcgtggaatttctttgaggttgaggactatggctttgggatgtttacgaccaatatatggatgaagtttcgcgagggatcttctgaggtgtgcgaccatcgcctgatgagcgctgcgatcaaagaccaaaaggccgtgcacgccgatatgggctactggatagagtccagcaagaaccagacctggcagattgagaaggcatccctcatagaggtcaagacctgcctctggcccaaaacgcatacgctgtggagcaacggcgtcctcgagtctcagatgctgatcccccggagctacgcgggccccttctcccagcataactaccgccagggatacgctacccagaccgccggcccctggcacctgggcaaacttgagatcgacttcggcgagtgtcctgggaccacggtcacgatacaggaggactgcgaccatcgggggcccagcctgagaaccaccaccgcgtctggcaagttagtgacccagtggtgttgtcgcagctgcaccatgccacccctcagattccttggggaagatggctgttggtacgggatggagatacgccccctgagcgaaaaggaggaaaacatggtgaaaagtcaagtcaccgctggccagggcacgagtgagaccttttccatggggctcttatgcctgaccttatttgtggaggagtgcctacggagacgtgtcacccgcaagcacatgatcctggtggtggtcatcacgttttgtgcgatcatactaggcgggctgacctggatggacctgctccgggcgctgatcatgctgggcgacaccatgagcggccgcatcgggggccagatccaccttgccatcatggccgtgttcaaaatgtcccccggatacgtcttaggcgttttcttgagaaagctcaccagccgagaaacagccctgatggtgatcggaatggcgatgaccaccgtgttctccatcccgcacgacctgatggagctcatcgacggcatcagcctgggcctcatcctcctgaagatcgtcacccactttgacaacacacaggtgggaactctggccctctctctgaccttcatccggtctactacacccctggtgatggcctggcggaccataatggccgtgttcttcgtcgttaccctcatacctctgtgccggacatcatgccttcagaagcagagccactgggtcgagataacggccctcattctgggcgcccaggccttacccgtgtacctcatgactctgatgaagggggcttcccgccggagctggcctctgaacgagggcatcatggcggtcgggcttgtctccctgctgggcagcgcattactgaagaacgatgtgccgcttgccggccccatggtggccggagggctcttgctggccgcgtacgtgatgtccggtagctccgctgatctcagcctggaaaaggccgcgaatgtgcagtgggacgagatggccgatattaccggtagctcccctatcatagaggtgaagcaagacgaagacggcagcttctccatccgcgacgttgaggagaccaacatgatcacgctgctcgtgaagttggccctgattaccgtgagcggcctctatccgcttgcgattcccgtaacgatggccttgtggtacgtgtggcaagtgaagacccagcggtccggcgctctctgggatgtccctagccccgctgccacgcagaaagctactctgagcgagggggtgtatcgcatcatgcagcgaggccttttcgggaagacccaggtcggtgtcgggattcacatggagggcgtgttccacaccatgtggcacgtgaccaggggcagcgttatctgccacgagacagggagactcgaaccatcgtgggccgatgtgcgcaacgacatgatcagctacggcggtggctggcgactgggcgataaatgggacaaggaagaggacgtgcaggtcctggccatagagcccgggaaaaaccccaagcatgtgcagaccaagccgggcctcttcaagaccctgacaggagaaatcggtgccgtgacgttggacttcaagccggggacctccggatcccccatcatcaacaagaagggcaaggtcatcggcctctacggtaatggggtggtgaccaaatccggcgactacgtcagcgctatcactcaagcggagcggatcggagagccagactacgaggtagatgaggacatcttccgcaagaagcggctgacgatcatggacctgcacccgggcgctggtaagaccaagagaatcctaccctccatagttcgggaggccctaaagcgtcggctgcgcacgctgatactggctcccacccgggttgtggccgcagaaatggaagaggccctgcgcgggctgcctatccgctaccagacaccagctgtgaaaagcgagcataccggccgcgagatcgtcgacctcatgtgccacgccacctttacaacgcgcctgctgtcctctacgcgcgtgccaaactataacctcatcgttatggacgaggcgcacttcactgacccctgctcggttgcagcgcgggggtacatcagcacccgcgtagagatgggagaggcagccgcgatctttatgaccgcgacgcccccgggcagcatcgaccccttccctcagtccaacagcccgattgaggatatcgaacgagagatcccggaacgctcctggaataccggcttcgactggattacagactaccaaggcaagacagtctggttcgttcccagcataaaagcgggtaacgacatcgccaattgcctaaggaagtccggcaagcgcgtgatccagttaagccgcaagaccttcgatactgagtatcccaagaccaagctcacggactgggacttcgtcgtgaccaccgacatctccgagatgggggcgaatttccgggcgggtcgcgtgatcgatccccgacgctgcctgaaaccggtcatcctgaccgacggtcccgagcgagtgatcctcgcaggccccattcccgtgactccggccagcgccgcgcagcggagagggcgtatcggacgaaatcccgcacaagaggacgaccagtacgtcttttccggggatccccttaaaaacgacgaagaccacgcccactggaccgaagccaaaatgctgctcgacaacatctacacccccgagggtatcatcccgacgttgttcggccccgagcgcgagaagacccaggccatcgacggcgagttccggctgcgcggggaacagcggaagaccttcgtggagctcatgcgccggggcgaccttccagtatggctgagctacaaggtggcgagtgccggcatcagctacaaggaccgcgagtggtgcttcaccggcgagcgtaataatcaaattctcgaggagaacatggaggtcgagatttggacgcgtgaaggggagaagaagaagctgcgacccaagtggctggacgcacgcgtctatgccgacccgatggccctaaaggacttcaaggagttcgcttctggtcgcaagagcataacgctagacatcctgacagagatcgccacccttcccacctatctctctagcaaggccaagctggccctggacaacatcgtaatgctgcatacaacggaaaaaggagggcgcgcctaccagcacgccttaaacgagctccctgagagcttggagaccctgatgctcgtggcgctgttgggagcaatgaccgccgggatattcctcttcttcatgcagggaaagggtatcggcaagctcagcatgggcctgatcgcgatagccgtggcgtccgggttactgtgggtagctgagatccagccccagtggatcgccgcgtctataatcttggagttcttcctcatggtgcttctgatccccgagcccgagaaacagaggacaccccaagacaatcagcttatctatgtgattcttacgattctgaccataattggcctcatcgccgccaacgagatggggctgatcgagaagacgaagacggacttcggcttctaccaagtcaagacggagaccaccatcctggacgtcgacctccgtccggccagcgcctggacactgtacgcggtggccacgaccatcctaacccctatgcttcgccacacaatcgagaacacgtctgccaacctgagcctcgcagccatcgccaaccaggcggcagttctcatgggactgggcaaaggatggccactacaccgcatggacctgggcgtgcccctgctggccatgggctgctactcgcaggttaatccgaccacgctcaccgccagcctggtgatgctgctagtgcactatgcgatcataggacccggattgcaagcgaaggcaactagagaggcccagaagcgcaccgctgccggcattatgaagaaccccacggtagacgggatcactgtcatcgacctggagcccatatcctacgatcccaagttcgagaagcagctcggccaggtgatgctgctcgtgctctgcgtcgggcagctcctgctcatgcggacgacatgggcgctgtgcgaggtgctgaccttagctaccgggcccgtgatgactctgtgggagggtaaccccggccggttttggaacactaccatcgccgtgtccacggcgaacatcttccgcggctcctatctggcgggagctggattggcattcagtctgatcaagaacgcccagacgccacggcgtggcaccggcaccaccggtgagactctgggcgaaaagtggaagcgacagctcaactccctggaccgtaaggagttcgaggagtacaagagaagcgggattctggaggtggacaggaccgaggcgaagtctgccttgcgggatggatctaagatcaagtacgccgtatcccgcggtagttccaagatccggtggatcgtagagcgcggtatgatcaagccgaagggtaaagttgtggacctggggtgtggtcggggcgggtggtcgtactacatggccaccttgaagaacgtcacagaggttaaagggtacaccaagggcggtccggggcatgaggagcctattcccatggctacttacggctggaaccttgtcaagctgcactccggcgtggacgtgttctacaagcccaccgaacaggtggacaccctgttatgcgatatcggcgagagctcgagcaacccgaccatcgaagagggccgaacgctccgcgtcctgaagatggtcgagccctggctatcgagtaaacccgagttttgcatcaaggtactgaacccttacatgcccactgtgatcgaggagctggagaagctccagcggagacacggtggaagcctcgttcggtgccccctgtcccggaactcgacccatgagatgtattgggtctccggagcgtcagggaacatcgtgtctagcgttaataccatctccaagatgctgctgaaccgctttaccacccgccaccggaagcccacctatgaaaaggacgtggatctgggtgctgggacacgaagcgtgtcaacagagaccgaaaaaccggatatgaccataatcggccggcgcctgcagaggctccgcgaggagcacaaggaaacctggcactacgaccaggagaatccttatcggacgtgggcctaccacgggagctacgaggcgccatccaccggaagcgcgtctagcatggtgaatggcgtcgtaaagttactgacgaagccgtgggatgtgatccccatggtaactcagctggccatgacggacaccacccccttcggacagcagcgcgtgttcaaggagaaggttgacaccagaacgccccaaccaaagcccggcaccagaatgattatgacgaccacggccaactggctgtgggccctgctagggaagaagaaatccccacgcttgtgcactcgcgaggagttcataagcaaggtacggagcaacgccgcgatcggcgccgtgtttcaggaagaacaggggtggaccagcgccagcgaggccgtgaacgatagccgcttctgggaactggtcgataaagagcgagccctacaccaagagggcaagtgcgagagctgcgtgtataacatgatgggcaagcgcgagaagaagttaggggagttcggccgagcgaaagggtctcgggccatctggtacatgtggctgggcgcccgcttcctcgagttcgaggccctgggcttcctgaacgaggaccactggttcagccgggagaactcctggagcggcgtggaaggcgaagggttgcaccgactgggctacatcctggaggacatcgataagaaagacggggacctcatctacgccgacgacaccgcgggatgggacacgaggataacggaggacgacttgttaaatgaggaactcatcacggagcaaatggcgcctcaccacaagaccctcgctaaggccatcttcaagctgacgtatcaaaacaaggtcgtgaaggtgctccgccctaccccgaagggcgcggtcatggacatcatcagccggaaagaccaacgcgggagcggccaggtaggcacctacggcctgaacaccttcaccaacatggaagtgcagctgatacgccaaatggaggcagagggtgtcataacacaggacgacatgcagaacccgaagggcctgaaggagcgcgtcgagaagtggcttaaagagtgcggcgtggaccggctgaagcgcatggccatatccggagacgactgcgtcgtgaagcccctcgacgagcgcttctctacgtccctcctgttccttaatgacatggggaaagtgcggaaggacatcccgcaatgggagcccagcaaagggtggaagaactggcaggaagtgccattctgttcccatcacttccataagatattcatgaaggacggacggagcctggtggtgccctgtcgcaaccaggatgagctgatcgggcgggctcgaatctcccagggcgccggctggagcctgcgggagaccgcttgtctaggcaaggcgtatgcgcagatgtggagcttgatgtattttcaccgccgcgacctccggttggcctcgatggctatctgtagcgcggtcccgactgagtggttccccacgtcaaggaccacctggtctatccacgcccatcaccagtggatgaccacggaagacatgcttaaagtgtggaaccgggtctggatcgaggacaatcccaatatgactgacaagacacccgtacacagctgggaggacatcccgtacctcgggaagcgcgaggacttgtggtgtgggagcctgatcgggctgtcctctcgggccacgtgggccaagaacatccacacggccattacccaggtccgcaatctcatcggtaaagaggagtacgtggattacatgcctgccatgaaacgttactccgcaccctttgagagtgagggcgtactgtag

SEQ ID NO: 26292 - RNA, 9867 nt, synthetic construct
  misc_feature 1..9867: note = derived and/or modified CDS sequence (opt11) from DENV-4__KC762695__SS-prME
  source 1..9867: mol_type = other RNA
tcgaccatgaccctgctttgtctaatcccgaccgccatggcctttcacctgagcacccgggacggcgaaccgctcatgatcgtggcgaagcacgagagaggccgccccctgctattcaagaccaccgagggcatcaacaagtgcaccctaatcgctatggacctgggggagatgtgcgaggacaccgtgacatacaagtgccctctgctcgtgaataccgagcccgaggacatagatagctggtgcaacctgacgtccacctgggtgatgtacgggacctgcacccagagcggggagagacggcgggagaaacgctccgtggcccttacgccacacagtggcatggggctcgaaacccgggccgagacctggatgtcctcggagggggcgtggaaacacgcgcagcgcgtggagtcgtggatcctgaggaaccccggctttgccctgctcgcggggttcatggcctacatgatcgggcagaccgggatccaacgcacggtgttctttgtcctgatgatgctggtggcgcccagctacggtatgcgctgcgtgggagtcgggaaccgcgatttcgtggagggcgtgtccgggggcgcctgggtagacctcgtgctggagcacggcggttgtgtgactaccatggctcagggcaagccaacactagacttcgaactcacgaagaccaccgcgaaggaggtcgccttgctgcgtacctattgcatagaggcgtcaatctccaacatcacgaccgcaaccagatgcccgacgcagggagagccgtacctcaaggaggaacaggaccagcagtacatttgcagacgcgacgtggtggaccggggttgggggaacggctgcggcctgttcggtaagggcggggtcgtgacgtgcgccaagttcctgtgtagcggtaagattaccgggaacctcgtccagatagagaaccttgagtatacggttgtggtgacagtccataacggcgacacgcacgccgttggcaacgacacttccaaccacggtgtcaccgccactatcacgccccgaagcccctcggtggaggtgaagctgccggattacggcgagctcaccctggactgtgagcctcggagcggaatcgacttcaacgagatgatcctgatgaagatgaagaagaaaacctggctcgtccacaagcagtggttcctggacctgcccctcccatggaccgcgggagccgacacctccgaggtgcactggaactacaaggaacgcatggtcacctttaaagtcccgcacgccaagcgacaggatgtgacggttctcgggagccaggaaggggccatgcacagcgccctggcgggcgccaccgaggttgactccggcaacggcaaccacatgttcgccgggcacctcaagtgtaaggtgcgcatggagaagctgaggattaagggtatgagctacaccatgtgctccgggaaattcagcatcgacaaggagatggccgagacgcagcacgggacaaccgtagtcaaggtgaagtacgagggcgccggggcgccctgtaaggtgcccatcgaaatcagagacgtgaacaaggagaaggtagtgggccgcatcatctccagcacccccttcgccgaaaacacgaactccgtcaccaacatcgagctggagccacccttcggggatagctacatcgtgatcggcgttggcgattccgcccttaccttacactggttccgcaagggctcgtccatcggtaagatgttcgagagcacctacaggggggccaagcggatggcgatcctgggcgagacagcctgggacttcggttccgtcggcggcctcttcacctctctagggaaggccatccaccaggtcttcggctccgtgtacacaaccatgttcgggggtgtctcctggatgatccgcatcctgatcgggctcctggttctgtggataggcaccaacagccggaacaccagcatggccatgacctgcatcgccgtgggcgggatcacgctgttcctcgggttcacggttcaagcggacatggggtgcgtggtgtcctggaacggcaaggaactgaagtgcggcagcgggatcttcgtagtggataacgtacacacctggactgagcagtacaaatttcagcccgagagcccagctcgcctggctagtgcaatcctcaacgcacacaaggacggcgtctgcgggatccggagtaccacgcgcctagagaatgtcatgtggaagcaaataaccaacgagctgaactatgtgctgtgggagggcgggcacgacctgaccgtggttgcgggcgacgttaagggagtcctgaccaaggggaagcgggccctaaccccgcccgtgaacgacttgaagtactcctggaagacctggggcaaggccaagatcttcacccccgaggcccgaaatagcaccttcctgatagacgggcccgacacgtccgaatgcccgaacgagcgtcgcgcctggaactttctcgaggttgaggactatggcttcgggatgttctctaccaacatctggatgaagttccgggaggggtcaagcgaggtctgcgaccatcgtctcatgtccgctgccattaaggaccaaaaggccgtgcatgccgacatgggctattggatcgagagctccaagaaccaaacatggcagatcgaaaaggcgagcctgatcgaggtgaagacctgcctctggcccaaaacgcacaccctgtggtccaacggggtcctggagtctcagatgctcatcccccgttcttacgcgggcccgttcagccagcacaattaccgccagggttatgctacccagatcgccggcccatggcatctgggaaaactggagattgacttcggcgagtgccccggcaccactgtgacgatccaagaggactgcgaccaccgggggccctccttgcgcacaaccacggccagcggcaagctggttacgcagtggtgctgccgcagttgtaccatgccacccctgcggttcctcggcgaggatggctgctggtacgggatggagatccgccccttatcagagaaggaagagaacatggttaaatcacaggtgaccgcgggtcagggcacctcggaaacgtttagcatggggctgctctgcctgaccctgttcgtggaggaatgcctacggagacgggtcacccgcaagcatatgatcttggtggtcaccatcacgttctgtgcaatcatcctgggcgggctcacctggatggacctccttcgagccctcatcatgctgggggacaccatgagtggccgaatcgggggccagatccacctggcgatcatggccgtgttcaagatgagccccgggtacgttctcggcgtcttcctgcggaagctgacctcccgagagacggccctcatggtgatcggtatggccatgaccaccgtatttagcatcccgcacgacttaatggagctgatcgatggcatctccctcggattgatcctccttaagatagtcacccattttgacgacacccaggtggggaccctggccctgagcctcaccttcatccggtccaccacgcccctggttatggcgtggaggaccatcatggccgttttcttcgtggtgaccctgattcctctctgccggaccagttgtctgcagaagcagtcccattgggtcgagattacggcgctaatacttggcgcccaggccctgcccgtgtacctgatgaccctcatgaagggagccagccggcgatcctggccgcttaacgagggcatcatggcggtgggcctggtaagcctacttggctccgccctgcttaagaatgacgtgcccctagccggccccatggtggccgggggactgcttctggcggcgtacgttatgagcgggagttccgccgacctgtctctcgagaaggccgccaacgtgcagtgggacgagatggccgacatcacaggctcctctcccatcatagaggtgaagcaagacgaagacgggtccttcagcatccgcgatgtggaggaaaccaacatgatcacgcttcttgttaagctcgctctgatcacggtgtccggcctttacccgctcgccatcccggtaacgatggctctatggtacatctggcaggtcaagacccaacgaagcggcgccctgtgggatgttccctcccccgtcgccacgcaaaaggcgaccctttcagagggggtgtatcgcattatgcagcgcggactgttcgggaagacccaggtcggggtcggcatccacatggagggcgtgttccacaccatgtggcacgttacccgcggctccgtcatatgccatgagacggggaggctcgaaccaagctgggccgacgtgcgcaacgacatgatctcctacggggggggctggcgcctgggcgacaagtgggataaggaggaagacgtgcaggtcctggcaatcgagccggggaagaacccgaagcacgtgcaaaccaagcccggcctgttcaagacgctcaccggagagatcggcgcagtgacgctggacttcaagccagggaccagcggctcacccatcataaacaagaagggcaaggtcatcgggctgtacggcaacggcgtcgtcaccaagagcggcgactacgtctcagccatcactcaagcggagcgcatcggggagcccgactacgaggtggacgaggacatttttcgcaaaaaacggctcacgataatggacctgcacccaggcgccggaaagaccaagcgcatcctgccttcgatcgtgcgagaagccctcaagaggcggctgcgcaccctaatcctggccccaacccgggtagtggcggctgagatggaagaggcactccgaggcctgcccatccggtaccagacgccggccgtcaagtccgaacacaccggccgagagatagtggacctcatgtgccatgccacctttaccacgagacttctgtcatccacccgagtgcccaactacaacctgatcgtgatggacgaggcgcacttcaccgatccctgcagtgtcgcagccagagggtacataagcacccgcgttgagatgggcgaggccgccgcaatcttcatgacggccacgcccccggggagtaccgaccccttccctcagagcaactcgccaatcgaggacatcgaacgagagatccccgaacgcagctggaacacaggcttcgactggataactgattaccagggaaagaccgtatggtttgtgcccagtatcaaggccgggaacgacatcgccaactgcctccgcaagagcggcaaacgcgtgatccagctgtcccggaagaccttcgacaccgagtatcctaagacgaagctgaccgactgggactttgtagtaaccacagatatcagcgagatgggagccaacttccgggcgggacgcgttatcgaccctcgtcgttgcctcaagccggttatcctgacagacggcccggagcgggtgatattggcgggccccatccccgtgacgccggcctctgccgcccagcggagaggccgcattgggcggaacccggcccaggaggacgaccagtatgtcttttcaggcgaccccctcaagaacgacgaggatcacgctcactggactgaggcaaagatgctgttagacaatatctacacccccgaggggatcatcccgaccctttttggccccgaaagagagaagacccaagccatcgacggcgagttccggctgcgcggggagcagcggaagaccttcgtcgagctcatgcgccggggtgacctccccgtgtggctgtcatataaggtggctagcgcagggatatcctacaaggaccgcgagtggtgctttaccggagagagaaacaaccagatcttagaggagaacatggaggtggagatctggacgcgcgagggggagaagaagaagctcaggcccaagtggctggacgcccgggtgtacgcagacccgatggcacttaaggacttcaaggaatttgcatcgggacggaagtccatcaccctcgacatcttgacggagatagccaccttgccaacctatctcagctccaaggcaaaactggccctggacaacattgtgatgctccatacgaccgagaagggagggcgcgcctaccagcacgcgttaaacgagctgcctgagagcctcgagaccttgatgttagtggccctcttgggtgccatgacagccgggatcttcctgttcttcatgcagggcaaggggataggcaagttgtccatcggcctgatcgccatcgccgtcgcgagcggactgctctgggtcgcggaaatccagccgcagtggatagctgcgagcattatcctggagttcttcctgatggtactacttatccccgaaccggagaaacagcggacgccccaggataaccagctgatctacgtgatcctcaccattctgactatcatagggctgatcgcggctaacgagatggggttaatcgagaagactaagacggactttggcttctaccaggtcaagaccgagaccacgatactggacgtggatctgcggccggcctccgcctggacgctgtatgcggtggccaccaccatcctgacccccatgctgagacatacgatcgagaatacgagcgccaatctttccctggctgcgattgcgaaccaagccgctgttctgatgggactcggaaagggctggccgctgcaccgaatggacctgggtgtgcccctcttagctatgggctgctacagccaagtgaacccaaccaccctgaccgcatccctcgtcatgctgttagtgcattacgcgatcatcggccctggcctacaggccaaggccacccgtgaggcccagaagcggaccgcggcaggtatcatgaagaatcccaccgtggatgggatcacggtcatcgacctggagcccatctcctacgaccctaagttcgagaagcagctggggcaagtcatgctcctggtgctgtgcgtcgggcagctcctgttaatgcgcacaacctgggccctctgcgaggtgcttaccctggccacggggcccatcatgaccctgtgggaggggaaccccggccggttttggaacaccaccatcgcggtctccaccgctaacatcttccgcggcagttacctggcgggggcaggactggccttttccctcatcaagaacgcacagactccccggcgtgggacaggcaccacgggggaaaccctgggggagaagtggaagcggcagttaaacagccttgaccgcaaggagttcgaagagtacaagcggtctggtatcctggaggtagatcgcaccgaggccaagagcgccctgcgggacgggagcaagatcaaacacgccgtgagcagaggctcctcaaagatccggtggatcgtggagcgcgggatgatcaagccgaaaggaaaggtcgtggatctcgggtgcggcagaggcgggtggtcctattacatggcgactttaaagaacgttaccgaagtcaaggggtacacgaagggcgggcccgggcatgaagagcccattcccatggccacttacggctggaacctggtgaagctccactctggtgtggatgtcttctacaaacctaccgagcaggtcgacaccctcctgtgcgatatcggagagtcaagcagcaaccccacgatagaggagggacgtaccctccgtgtgctaaagatggtcgagccctggctgtccagtaagcccgagttctgcattaaggtcctcaatccctacatgcccaccgtgatcgaggagctggagaagctgcagaggcgccacgggggttccctggtccggtgccccttatcccgcaactccacccacgagatgtactgggtgagcggcgcgtcagggaacatcgtcagctcagtgaacacgatctctaagatgctgttgaaccggttcaccacccgccaccgaaagcccacctatgagaaggacgtggacctcggcgccggaacgcgctccgtcagcaccgagacagagaagccggacatgaccatcataggccggcgcctgcagcggctgagggaggagcacaaggagacatggcactacgaccaggaaaacccttaccgtacttgggcctaccacgggtcatacgaggcacctagcaccggatcggcgagttccatggtgaatggggtggtcaagctactgaccaagccgtgggacgtgatccctatggtgacccagctagccatgacggacacaacccccttcgggcagcagcgcgtcttcaaggagaaagtagacacgcggactccccaaccgaagcccggcaccaggatgatcatgaccacgaccgccaactggctctgggccctgctggggaagaagaagtccccgagactctgtacgagggaggagttcatttccaaggtacggagcaacgccgcgatcggcgccgtcttccaggaggagcaggggtggaccagcgcatccgaggccgtgaacgacagccgcttctgggagcttgttgacaaagagcgagccttgcatcaagagggtaagtgcgagtcctgcgtctacaacatgatgggcaagcgcgaaaagaagctaggggagttcggtcgcgcaaaggggagccgggcgatctggtatatgtggctgggggcccgcttcctggagttcgaagccctcggattcctgaacgaggaccactggttctcacgggagaacagctggtccggcgtagagggggaggggctgcaccgtctcggctacatactggaggacattgacaaaaaggacggtgacctgatctacgccgacgatacggcgggatgggacacccgaatcaccgaggacgatctactgaacgaggaactgatcaccgagcagatggcgccccatcacaagacactcgccaaggcgatcttcaagctgacctaccaaaacaaggtggtcaaggtgttgcgccccacccccaagggcgcggtgatggacatcatcagccggaaggatcagcgcgggagtggccaagtcggcacctacggccttaacacgttcacgaatatggaggtccagttgatacgacagatggaggccgaaggcgtgatcacccaggacgacatgcagaaccctaagggcctggaggaacgcgtcgagaagtggctcaaggagtgcggcgtcgaccggctgaagcgcatggccatcagcggagacgattgcgttgtcaagcccctggatgaacggttctccaccagcctcttgttcctaaacgacatgggtaaggtgcggaaggacataccgcagtgggaaccctccaaggggtggaagaactggcaggaggtgcccttctgtagccaccactttcataagatcttcatgaaggatgggcggtccctcgtcgtcccctgcagaaatcaggacgaactgatagggcgggcccgcatctcgcagggcgccggctggtccctgcgagagaccgcgtgtctcgggaaagcctacgctcagatgtggagcctgatgtatttccatcgccgcgatctgcgcttagccagcatggctatctgctccgccgtcccgacggagtggttccccataagccgcaccacttggtccatccacgcccaccatcagtggatgaccacggaggacatgctgaaagtgtggaaccgggtttggatcgaggataaccccaacatgactgacaagacccccatacacagctgggaagacatcccgtacctgggcaaacgcgaggatctctggtgcgggtccctgatcggcctgtcgtcccgggccacatgggctaagaacatccacacggccatcagccaagtgcgcaacctcatagggaaggaggaatatgtcgactatatgccggtgatgaagcggtactccgcgcccagcgagagtgagggtgtgctgtga

SEQ ID NO: 26293 - RNA, 9867 nt, synthetic construct
  misc_feature 1..9867: note = derived and/or modified CDS sequence (opt11) from DENV-4__KC762696__SS-prME
  source 1..9867: mol_type = other RNA
agcaccatgaccctcttgtgcctgataccaaccgttatggcctttcacctgagcaccagagacggcgagccgttgatgatagtggccaagcacgagcgggggcgccctctgctgttcaagaccaccgagggtattaacaagtgtaccctcatcgcgatggacctgggggaaatgtgtgaggacaccgtaacctacaagtgtcctctgcttgtgaacaccgagcccgaagacatagactgctggtgcaaccttacctccacgtgggtgatgtacgggacgtgcacgcaatccggggagcggcgcagggagaagagaagcgtcgccctaacgccgcactccggcatgggcctggagacgcgggccgagacctggatgtcttccgagggggcgtggaagcacgcgcagcgcgtggagagttggatcctgcggaaccccggcttcgcactgctcgccgggttcatggcatatatgatcggccagacagggattcagcgcacggtattcttcgttctaatgatgctggtggcacccagttacggcatgcggtgcgtcggcgtgggaaaccgcgacttcgttgaaggagtcagcggaggggcgtgggtggacctcgttctcgaacacggcgggtgcgtaaccaccatggcccaggggaagccgactctggatttcgagcttacgaagactaccgcaaaggaggtggccctgctgcgcacctactgtatcgaagcctccatatccaacatcacgaccgcgacccgctgcccaacccagggggagccctacctcaaggaagaacaagaccaacaatacatctgccggagggacgtagtcgaccggggctgggggaacggatgcggcctgttcgggaagggcggagtggtcacttgcgccaagttcctttgctccggtaaaatcaccgggaacctcgtccagatagagaatctggagtataccgtggtggtcaccgtgcataatggcgatacgcacgccgtcggaaacgataccagcaaccatggagtgaccgccaccattacaccgcgctccccgagtgtcgaggtcaagctgcctgactacggcgagctcaccttggactgcgagccaaggtcggggatcgactttaacgagatgattctgatgaaaatgaagaagaagacctggcttgtccataagcagtggttcctggaccttcccctcccgtggaccgccggggcggatacaagcgaggtgcactggaattacaaggaacgcatggttacgttcaaggtgcctcacgccaaaaggcaagacgttaccgtcctggggtcccaggagggcgccatgcacagcgcccttgctggggcaaccgaagtcgacagtggggacggcaatcacatgttcgccgggcacctgaagtgtaaagtacgcatggagaaactgaggatcaagggcatgtcgtatactatgtgcagcggcaagttcagcatcgacaaggagatggccgagacgcagcacggtaccaccgttgtaaaggtgaagtacgaaggcgccggcgccccgtgcaaggtccccatcgagattcgcgacgtgaacaaggagaaagtggtcggccgcatcatcagctccactcccttcgcggagaacacgaacagcgtaaccaacatcgagctggaaccgccctttggggactcctacatcgtgatcggcgtcggcgactccgccctcaccctgcattggttcagaaaggggtccagcattggtaagatgttcgagtccacttaccggggagctaagcggatggccatcctgggcgagacggcctgggacttcgggagcgtgggcgggctctttacctccctggggaaggccgtccaccaggtcttcggcagcgtgtacaccaccatgttcggcggcgtgtcctggatgatccgtatcttgatcggcttcctcgtcctgtggatcggcaccaacagccggaacacctccatggccatgacctgcatcgccgtgggcgggatcaccctgttcctggggttcactgtgcaggccgacatgggctgcgttgtgagctggaacggcaaggagctcaagtgcgggtcgggtatctttgtggtcgataacgtgcacacctggaccgaacaatataagttccagcccgaaagccccgcgcgcctggcgagcgccatcctgaatgcccacaaggacggggtgtgcggtatccggtccaccactcgactcgagaacgtcatgtggaagcagattacaaacgagctgaactacgtgctgtgggaaggtggacacgaccttaccgtggtcgccggcgacgtgaagggagtactcaccaaagggaagcgggcgctgaccccgcccgtcaacgaccttaagtacagctggaagacctgggggaaggccaaaatttttacccccgaagctaggaacagcaccttcctgatcgacggcccagacacgagcgagtgccctaacgagcggagagcctggaacttcttcgaggtggaagactacggcttcgggatgttcaccaccaacatctggatgaagttccgggagggctcgagcgaggtgtgcgaccaccgcttaatgtccgcggcaatcaaggaccagaaggcggtccacgccgacatgggatactggatcgagagctccaagaaccagacgtggcaaatcgaaaaagcaagcctcatcgaggtaaagacttgcctctggcccaagactcacactctttggtccaatggtgtgttggagtcacagatgctgatccctcggtcctatgcgggaccgttctcacagcacaactaccgccaagggtacgccacgcaaaccgctgggccctggcacctcgggaaactcgaaatcgacttcggcgagtgtcccggtacgacggtcaccatacaggaggactgcgatcaccgtggtccgtccctcaggaccacaaccgccagcggcaagctggtgacacagtggtgttgcaggagttgtaccatgccgcccctccgcttcctgggggaggacggctgctggtacggaatggagatccgccccttaagcgagaaggaggagaacatggtcaaaagccaagtcacggccggccaaggcacctccgagaccttcagcatggggctcctgtgcctgaccctcttcgtggaggaatgtttacggcgccgggtcacccgcaagcacatgatcctggtggtggtaatcactttctgcgcgatcatcctcggcgggctgacctggatggacctgctccgggccctgatcatgttgggcgacacgatgtccggcagaatcggcgggcagatccatctagccatcatggccgtgtttaagatgagccccgggtatgttctgggcgtgttcctgcggaagctaacatcccgagagaccgccctgatggtgatcgggatggcgatgaccaccgtgttctccatcccgcacgacctgatggagctcatcgacggcatttccctgggcctgataatacttaagatcgtgacgcacttcgataacacccaagttggtaccctggccctttctttaaccttcatccgtagcactacgccccttgtgatggcctggaggactatcatggccgtcttctttgtggtgacccttatccccctttgccggacgtcttgccttcagaaacaatcccactgggtcgaaataaccgccctgattctcggagcgcaggcgctgcctgtgtacctgatgaccctcatgaaaggggccagccgccggtcctggccgctgaacgagggcatcatggcggtggggctggttagcctcctgggcagtgcgctgctaaagaacgacgttcccctggccggtcccatggtggccgggggcctgttgctggccgcctatgtcatgagcgggtcctccgcggacctgtccctcgagaaggccgccaacgtgcaatgggacgagatggccgacatcaccggcagctctcccattattgaggtgaagcaggacgaggacgggtccttcagcatccgtgacgtcgaggaaactaacatgattaccctgctggtaaagctcgccctgatcaccgtctccggcctgtacccattagcgatcccggtcaccatggccttgtggtacgtgtggcaggtcaagacacagcgaagcggcgccctgtgggacgttccgtcgcccgccgctacacaaaaggcgacactgagcgaaggggtctaccgcataatgcagcgaggcctgttcgggaagacccaggtgggcgtcgggatccacatggagggcgtgttccacaccatgtggcacgtaacgaggggctccgtcatttgccacgagaccgggcggctggagccgtcatgggccgacgtgcgtaacgacatgatatcctacggcgggggttggcgcctcggcgataagtgggacaaagaagaggatgtgcaggtcctggccatcgagcccggcaagaaccccaagcacgttcagaccaagcccggactattcaagacgctcacgggggagatcggcgccgtgaccctggacttcaagcccgggaccagcggcagtcccattatcaataagaagggcaaggtcatcgggctgtacggcaatggggttgtgaccaagagcggggactacgtcagtgcaatcacacaggcggaacggatcggggagccagattacgaggtggacgaggacatcttccgcaagaagaggttaaccatcatggacctacacccgggcgccggcaagaccaagcgcattcttccctcgatcgtacgagaggctttaaagcgacgactgcgcaccctgatcctcgcccccacgcgggtcgtggcggccgagatggaggaggcgttgcgcggccttcccatccggtaccaaacgccggccgtgaaaagcgagcacaccggccgcgaaatcgttgacttgatgtgtcacgcaacctttaccacccggctcttatcatcgacccgagtgcccaactataacctgatcgtcatggacgaggcacacttcactgatccctgcagcgtggccgcccggggatacatcagtacccgcgtggagatgggcgaagcagccgcgattttcatgaccgctacacccccggggtctattgaccctttcccccaaagtaactcccctatagaggacatcgagcgggaaatcccggagcgcagctggaacaccggctttgactggatcaccgactatcagggcaaaaccgtgtggttcgtcccctcgatcaaggccgggaacgacatagccaactgcctccgcaagagcgggaagagggtgatccaattatccaggaaaaccttcgacaccgagtaccccaagacaaagctgaccgactgggacttcgttgtgactaccgacatcagcgagatgggggccaacttccgggcgggtcgcgtgatcgaccctcggcgctgcctcaagccggtaattctgacagatgggcccgagagagtgatcctggccggccccatccccgtgacccccgcctccgccgcgcagcgccggggcaggatcggacggaatccagcccaagaggacgaccaatacgtcttcagcggcgaccccctcaagaacgacgaggaccacgcccactggaccgaggccaagatgctgctggacaatatctacaccccagaggggatcatcccgaccctattcggccccgagcgcgaaaagacccaggccattgacggcgagtttcggctgcgcggggagcagcgcaagacttttgtggagctgatgagacggggagacctccccgtgtggctttcctacaaggtcgcgagcgccgggatctcctacaaggaccgcgagtggtgcttcaccggggagagaaataaccagatcctggaggagaatatggaggtggagatctggactagggagggagagaagaagaagttgcggcccaagtggttagacgcgcgcgtgtacgccgatccgatggcattaaaggactttaaggagttcgcgagcgggcggaagtccatcacgctcgacatactgaccgaaatagccaccctacccacctacctcagcagcaaggccaagctagccctggacaacatcgtcatgttacacacgaccgagaagggcggacgcgcctatcaacatgcgctgaacgagctgcccgagtcactcgagaccctgatgctggtggccctcctgggagcgatgaccgccgggatcttcttattcttcatgcagggaaagggcattggcaaactttccatgggactgatcgcgatcgccgtcgccagcggcctgctctgggttgcggagatccagccgcagtggatcgccgcgtcgatcattctggagttcttcctgatggtgctcctgatccccgagcccgagaagcagcgtacaccccaggataaccagctgatctacgtgatcctcaccatcctgaccatcatcggcctgattgccgccaacgagatggggctcatcgagaagaccaagacggacttcggcttctaccaggtcaaaaccgagaccacaatcctggacgtggacttgcgcccggcctccgcctggacgctgtacgcggtcgctaccaccatcctgactcccatgctgcgccacacgatcgagaatacctcggctaacctctcccttgccgctatcgcaaaccaagctgccgtactgatggggctgggcaagggctggccactgcaccggatggacctgggagttcccctcctcgccatgggctgctactcacaggtaaatccgaccaccctgacggcttccctagtcatgttgctggtgcactatgcgatcatcgggcccggcttgcaggccaaagctacccgcgaggcccagaagcggaccgcggccggcatcatgaagaaccccacggtggacgggatcacggttatcgacttggagcccatcagctacgatccgaagttcgagaagcaactgggccaggtgatgctgctggtgttatgcgtcgggcagctcctgctgatgcgcaccacctgggccctctgcgaagttctgaccctagcaacgggcccggtgatgaccctctgggaggggaatcccggacggttctggaacaccaccatcgctgtctccaccgcgaacatcttccgcggcagctacctggccggggccggcctggcctttagcctcatcaagaacgctcaaacgccccgtcgcgggacgggtacgacgggggagaccctgggcgagaagtggaagcgccaactgaatagcctagatcgcaaggagttcgaggaatacaagcggtcggggatcctagaggtggaccgcaccgaggcaaagagcgccttacgggacggttccaaaatcaagtatgccgtcagccggggctccagcaaaatccggtggatagtcgagcgcggcatgatcaaacccaagggcaaagtggtggacctagggtgcggccggggcgggtggtcctactacatggccacgttaaagaacgtgaccgaagtgaagggctacaccaaagggggccccgggcacgaggagccgatccccatggccacctacgggtggaacctggtgaaacttcactctggcgtcgatgtgttctacaagccgaccgagcaagttgacaccctgttgtgcgatatcggggagtccagctcaaaccccaccatcgaagagggccgcacactccgcgtcctaaagatggttgagccctggctcagcagcaagcccgagttctgcatcaaggttctcaacccctacatgcccaccgtgatagaggaactggaaaagctgcagcggcgccacgggggctccctcgtacggtgccccctgagccgcaactccacccacgaaatgtattgggtctctggcgcgtccgggaacatcgtgagctccgtgaatacgatttccaaaatgctgttaaaccgttttaccaccaggcaccggaagcccacgtacgagaaggacgttgacctcggcgccgggacgcgctccgtgtccactgagaccgagaagccggacatgaccatcataggacggcgcctgcagagactacgggaagaacacaaggagacgtggcactatgaccaggagaacccctaccgcacatgggcttaccacgggtcctatgaggcacccagcacaggctccgcgagctccatggtgaatggcgtggtgaagctcctgaccaagccatgggacgtgatccccatggtcactcagttagccatgactgacaccacgccttttgggcagcagcgggtgttcaaagagaaggtggacacgcggacgccccagcctaagcccggcactcgcatgataatgacgacaactgcaaactggctctgggccctgctggggaaaaagaagtcaccgcggctctgcaccagagaggagttcatttccaaagtccggtctaatgctgcgattggggccgtcttccaggaagaacaagggtggacctccgccagcgaagccgtgaacgactctaggttctgggagctggtcgacaaggagcgggccctgcaccaggagggcaagtgcgagtcctgcgtgtacaacatgatgggcaagcgcgagaagaagctcggggagttcggccgtgcgaaggggtcgcgcgccatttggtatatgtggctgggcgcgcgctttctggagttcgaagccctcggattcttgaacgaggaccactggttctcccgggagaacagctggagcggcgtggagggcgaggggctgcatcgcctcggctacatactggaagatatcgacaaaaaggacggggacctgatctacgccgacgacacggcgggctgggacacacggatcacagaggacgacctcctgaacgaggagttaatcacagagcagatggctcctcaccacaagacgctggccaaggccatcttcaagctgacctaccagaacaaggtcgttaaggtgctgcgcccaacacccaagggcgcggtcatggatatcatcagccggaaggaccagcgtgggagtggccaggtggggacgtacggcctcaacactttcacgaatatggaggtgcaactgatccggcaaatggaggcggagggggtcataacccaggacgacatgcagaatcccaagggcctgaaggagagggtggagaaatggctcaaggaatgtggcgtggaccggctgaagcgcatggcgatcagcggggacgactgcgtcgttaaaccccttgatgagcggttctccaccagcctcttgttcctaaacgacatgggcaaggtgcgcaaggacatcccccaatgggagccctccaaggggtggaagaactggcaggaggtccccttttgctcgcaccacttccacaagatcttcatgaaggacggcagatccttagtggtcccatgccgcaacccagacgagttgatcgggcgcgctcgcatcagccagggcgccggctggtccttgcgggagaccgcctgcctggggaaggcctacgcccaaatgtggagcctgatgtacttccaccgccgcgacttacggctcgcctccatggcgatttgcagcgcggttcccacggagtggttccccaccagccgcaccacatggtccatacacgcccaccaccagtggatgactacggaggacatgctgaaggtgtggaaccgcgtgtggatcgaggacaaccccaacatgaccgacaagaccccggtccacagctgggaggatatcccgtacctcggcaagcgcgaggacctctggtgcgggtcactgataggcttaagctcccgggccacgtgggccaagaacatccacacagccattacacaggtgcgcaacctcataggaaaggaggagtacgtggactacatgcccgcaatgaagcggtattccgcccccttcgaatccgaaggcgtgctgtga

SEQ ID NO: 26294 - RNA, 9867 nt, synthetic construct
  misc_feature 1..9867: note = derived and/or modified CDS sequence (opt11) from DENV-4__KC762697__SS-prME
  source 1..9867: mol_type = other RNA
agcaccatgacccttctctgcttgatccccactgccatggcttttcacctgagcacccgggacggggagccgctcatgatcgtggcgaagcacgaacgggggaggcccctgctgttcaagactacggaaggcatcaacaagtgtaccctgatcgccatggacctgggggagatgtgtgaggacaccgtgacctacaagtgccccctgcttgtgaacaccgaaccggaggatattgactgttggtgcaacctcacgagcacctgggtgatgtacgggacctgcactcagagcggggagcggcgccgggagaagcgcagcgtggccctgacgccgcacagcggcatgggcctcgagacccgggccgagacctggatgagctccgagggggcttggaagcacgcgcagcgcgtcgagtcctggatcctgcgaaacccgggcttcgcgctgctcgccggcttcatggcttacatgatcgggcagacggggatccagcggacggtgtttttcgtgctgatgatgttagtggcgcccagctatggcatgcggtgtgtgggtgtcgggaaccgcgactttgttgaaggggtgagcgggggagcctgggtcgacctcgtgctggagcatggtgggtgcgttaccactatggcccagggcaagcccacactggacttcgagctcacgaagaccacggccaaggaggtcgctctgctgcggacttattgtatagaggcgtccatcagcaacatcacaaccgccacccgctgcccgacccaaggggagccttacttaaaggaggagcaggaccagcagtacatctgccggcgcgacgtggtggaccgggggtgggggaacggctgcggcttgttcgggaagggcggggtggtgacgtgcgccaagtttctgtgctctgggaagatcaccggtaacctggttcagatcgagaatctagagtacaccgtcgtggtgactgtacacaacggagacacgcacgccgtgggcaacgacaccagcaaccacggggtaaccgccaccatcacaccccgctctcccagtgtggaggtaaagttgccggattacggtgagctcaccctggactgcgaaccccggtccgggatcgacttcaacgagatgattctgatgaagatgaagaagaagacttggctcgtccacaagcagtggttcctggacctgcccctcccctggaccgcgggcgccgacaccagtgaggtgcactggaattacaaggagcgcatggttacgttcaaagtcccgcacgccaagcggcaggacgtgacggtgctggggtcccaggagggcgcaatgcactccgcccttgccggagctaccgaggtagacagcggggacggcaaccatatgtttgcagggcacctcaagtgtaaagtgcgcatggagaagctgagaatcaagggcatgtcctacaccatgtgctcaggcaaattctccatcgataaggaaatggccgagacgcagcacgggaccaccgtggtcaaggtgaagtacgagggggccggggcgccgtgcaaggtgcccatcgagattcgagacgttaacaaggagaaagtcgtgggccggatcatctcgtcaacgcctttcgccgagaacacaaattctgtaaccaacattgagctggagccaccattcggggattcctacatagtgatcggagtgggcgacagcgccctcaccctgcactggtttcggaaggggtcaagcattggcaagatgtttgagtccacttatcgcggagccaagcggatggcgatcctgggcgagacggcatgggatttcgggagcgtcggcggtctcttcacctccttagggaaggcagttcaccaggtgttcggcagcgtctacactaccatgttcggtggcgtgtcctggatgatccgcatcctgatcgggcttctggtgctgtggatcggcacgaacagccggaatacatccatggccatgacctgcatcgcagtcggcgggattaccctcttcctggggttcacggtacaggcggacatggggtgcgtcgtcagctggaatggcaaggagcttaagtgcgggtccggcatcttcgtggtggacaacgttcacacctggactgagcagtacaagttccagcccgagagccccgcccgccttgccagcgccattctcaacgcccacaaggatggagtgtgcggtatccgctccaccacccgcctggagaacgtgatgtggaagcagataactaacgaactgaactacgttctctgggaaggagggcacgacctcacagtggtggccggcgacgtcaaaggcgtcctgaccaagggtaagagagtgctcaccccgcctgtcaacgatctgaagtacagctggaagacctggggcaaggccaagatcttcacccccgaggcccgcaactccaccttcctgatcgacggtcccgacacgagcgagtgcccgaacgagcggagagcttggaacttcttcgaggtggaagactatggatttgggatgttttccaccaacatctggatgaaattccgggagggcagctccgaggtgtgcgaccaccgcctcatgtcagccgcgatcaaagaccaaaaggccgttcacgctgacatggggtactggatcgagtccagcaaaaaccagacctggcagatcgagaaggcgtccctgattgaagtgaagacctgcttgtggcccaagacgcacaccctctggagcaatggtgtgctggagtcccagatgctcatcccacggtcatacgcgggcccgttcagtcagcacaactaccgccaggggtacgccacccagatcgccggcccctggcacctcgggaagttggagatagacttcggcgagtgcccgggcaccaccgtcacgattcaggaggactgcgaccaccggggccccagccttaggacaaccaccgcctccggtaagctcgtaacgcagtggtgttgccgcagctgcacgatgccacccttacggttcctgggggaggatggctgctggtacggcatggaaatccgccccctctcggagaaggaggagaacatggtcaagtcacaggtcaccgccggccagggcacgagtgagactttcagtatgggcctgctgtgcctcacactgttcgtcgaggagtgtctgagacggcgggttaccaggaagcacatgatcctcgtcgtggcgattaccttctgtgccatcatactaggagggctcacgtggatggatctccttcgggccctaatcatgctcggcgacaccatgagcggccgcatcgggggccagatccacctggccattatggccgtattcaagatgtcccccggatacgtcctgggagtgttcctcaggaaactgacatcccgagagaccgccctgatggtcatagggatggccatgacaactgtattcagtatcccgcacgacctcatggagctgattgacggcatcagcctgggcctcattctgctgaagatcgtgacccacttcgacgacacccaagtcgggacgctcgccctgtcactcacattcatccggagcaccacaccgcttgtgatggcctggcgcacgatcatggccgtgttcttcatggtaacactgatccccctgtgccggacttcctgcctccagaagcaaagccactgggtggagatcaccgcgctgatcctgggcgcccaggccctccccgtgtacctcatgacccttatgaaaggggcctctcgccggagctggccgcttaacgagggcatcatggcggtcggtcttgtttccctactcggcagcgccctactgaaaaatgacgttcccctcgccggcccgatggtagccggcggccttctgcttgccgcgtacgtgatgtccggaagctccgccgatctatctctggagaaggccgcaaacgtgcaatgggatgagatggcggacatcaccggcagcagccccatcatcgaagtaaagcaggacgaagacggaagtttctccatccgcgacgtcgaggagacaaacatgatcacccttctcgtgaagttagccctcatcacggtcagcggtctctacccgctggccatacccgtgactatggccttgtggtacatttggcaggtcaagacccaacgttccggcgccctatgggacgtccccagccccgcggcgacccagaaggccacgctttccgagggggtgtatcgtatcatgcaacgaggcctattcgggaagacacaggtgggcgttggcattcacatggaaggcgtgttccatacgatgtggcacgttacccgcggcagcgtcatctgccacgaaaccggccggttggagccgtcctgggcagatgtgagaaacgacatgatctcatacggtgggggctggaggctgggcgacaagtgggacaaggaggaagacgttcaagtcctcgccatcgagcccggcaagaaccccaagcacgttcagacgaagccaggcctgttcaagaccctgaccggggagattggcgcagtgacactcgatttcaagccgggtacgtccggcagccccattatcaataaaaagggcaaagtgatcgggttatatggtaacggggtggtaaccaagtccggggactacgtttctgcgattacgcaggcagaacgaataggagagccagactacgaggtggacgaggacatcttccggaaaaagcggctgaccatcatggacctgcaccctggcgccggcaagacgaagcgaatcctgccctcaatcgtgcgggaggcgctaaagcggaggttgcgcaccctgatcctggcgcccacccgggtcgtggccgctgagatggaggaagcactacgcgggcttcctatccggtaccagacccctgcagtgaaggcggaacacacgggccgcgagatagtcgacctcatgtgccacgccacgttcaccaccagactgctctcctccacgcgcgttccaaactacaacctgatcgttatggacgaggcccacttcactgacccctgtagtgtcgccgctcgggggtacatctccacgcgggtggagatgggcgaggcagccgcgatcttcatgaccgcaacgcccccggggtccaccgacccctttccgcagagcaactcccccatcgaggacatcgagcgtgagatcccggagcgcagctggaataccggcttcgattggatcaccgactaccagggcaagacggtctggttcgtaccttccatcaaggcggggaacgacatagccaactgcctgcgtaagagcggcaagagagtgattcagctgtcgcgcaagacctttgacaccgagtatcccaagacgaaactgacggactgggacttcgtcgtgaccaccgatatcagcgagatgggcgccaatttccgggccggcagagttatcgacccccggcgctgcctgaaaccggtcatcctcaccgacgggcccgagagggtgattcttgcaggccccatccccgtgacaccggcctccgccgcccagcgccggggccgcatcggacggaaccctgcgcaggaggacgaccaatatgtcttctcgggcgaccccctgaagaacgatgaggaccacgcccactggaccgaggcgaagatgttactggataacatctacacccccgaggggatcatcccgactctgttcggccccgagcgcgaaaagacgcaggccatcgacggtgagttccggctccgcggggagcagagaaagaccttcgtggagctgatgcgccggggcgatctgccagtctggctctcttacaaggtcgcatctgcggggatctcctacaaagaccgcgagtggtgctttaccggcgagcgaaacaaccagattctggaggagaacatggaggtggagatctggacccgcgagggtgagaaaaagaagctgaggcccaagtggcttgacgcacgggtgtatgcggatccgatggcgctgaaggatttcaaagagttcgccagcggccggaaatcgataacgcttgacattctcacggaaattgccaccctgcccacctacctaagctccaaggccaagctcgctctggacaacatcgtcatgctgcacaccacggagaaaggcgggcgcgcctaccagcacgctctcaacgagctgccggagtctctggagaccctcatgctggtggccctgctcggggcaatgaccgccgggatcttcttattctttatgcagggcaaggggatcggcaagttgtccatgggccttatcgccatcgccgtggcatcaggccttctgtgggtcgctgagatccagccgcaatggatcgccgcctcaatcatcctcgagtttttcctgatggtgctgctcatccctgaaccggagaagcagaggacgccacaagacaaccagctgatctacgtgatactgaccattctcaccataatcggcctgatcgccgccaacgagatggggttgatcgagaagaccaagaccgatttcggcttttaccaagcgaaaactgagaccactatcctcgacgtcgacctgcggccggccagcgcctggacattatacgctgtggccaccacgatcctcaccccgatgctacgccacaccatcgagaacacgagcgcgaacctttccctcgccgccatcgccaaccaggcggctgtgctcatggggttgggcaagggctggcccctccaccggatggacctgggggtccccctcctggctatgggctgttacagccaggtaaatccgacaaccctgaccgcctccctcgttatgctcctggtacactacgccattatcgggcccggcctgcaggctaaggccacgcgggaggcccaaaagcggaccgccgccggtatcatgaagaaccccaccgttgacgggatcaccgtgatcgacctcgagccaattagctacgacccgaagttcgagaagcagcttggccaagtcatgttgttagtgctgtgtgtggggcagctgctcctgatgcgcacgacctgggccctatgtgaggttctgacactggccacggggcccataatgaccctgtgggaagggaatcccggccggttctggaacacgactattgccgtgtccaccgccaatattttccgtggaagctacttggccggggcgggcctagccttctcgctgatcaagaacgcgcagacgcctaggagggggaccgggactaccggtgagacgctaggcgaaaagtggaagcggcagctgaacagccttgaccgcaaggagttcgaggagtacaagcgttccgggatcctcgaggtggatcgcacagaagcaaagtcagccctgcgggacgggtcaaagatcaagtacgcagtcagccgcggctcgagcaagatccgatggatcgtagaacgtgggatggtgaagcctaagggtaaagtcgtggacttaggttgtggccgaggcggctggtcatactatatggcgactctaaagaacgtgaccgaggtaaaggggtacaccaagggcggacccgggcacgaggagcccatacccatggccacgtacggctggaacctggtgaagttacacagcggcgtggacgttttctacaagccaaccgaacaggtcgacaccctcctgtgcgacatcggggagtcctcctccaaccccacaatcgaggagggccggacgctgcgagtattaaagatggtcgagccgtggctgagcagtaaacctgagttctgcatcaaggtgctcaacccgtacatgcccaccgtgatcgaggagcttgagaaactgcagcggcgccacggtggctcgctggtccggtgcccgctgtcgcggaactccacccatgagatgtactgggtgtcaggtgcttccggaaacatcgtcagctcggttaacaccatttccaagatgctcctgaaccggttcacgaccagacaccggaaacccacctacgaaaaagacgtcgatctgggcgcgggtacacgctccgtcagcacggaaaccgaaaagcctgacatgacgataatcggccggcgccttcagcggctgcgcgaggagcataaggagacctggcactatgaccaggaaaacccctaccgaacgtgggcctatcacgggtcgtacgaggccccctccactggctccgccagctccatggtaaatggggtggtaaagctgctcacaaagccctgggacgtaatccccatggtgacccagttagccatgacggatacaaccccctttgggcagcagcgtgtcttcaaggagaaggtggacacccgcacgccccaaccgaagcccggaacccgcatgatcatgaccaccacggcgaattggctgtgggccttgctagggaagaaaaagtccccgcggctttgcacccgcgaggagtttatctctaaggtccggagcaacgccgctatcggcgccgtcttccaggaggagcaagggtggacctccgcgagcgaggccgtgaacgacagccgcttctgggagctagttgacaaagaacgcgccctgcatcaggagggcaagtgcgagtcctgcgtctacaatatgatgggtaagcgcgagaagaagctgggggagtttggccgcgccaaggggagccgagcaatctggtacatgtggctgggagcgcgcttcctggagtttgaggccctgggatttttgaacgaagaccactggttcagtcgggaaaattcatggtctggcgttgagggcgaggggctgcatcgtctggggtacatcttagaggacatcgacaagaaggacggtgacctgatctacgccgacgacaccgccggctgggacacccgaattactgaagacgatttactgaacgaggagttgatcaccgagcaaatggcaccccatcacaagaccctggctaaagcgatttttaagctcacctaccagaacaaggtggttaaggtcctgcgcccaacgcccaagggcgccgtgatggacatcataagcaggaaggaccagcgcggttccggccaggtcgggacctacggcctgaacacctttacaaacatggaggtacagctcatccggcagatggaggccgaaggtgtgatcacccaggacgacatgcagaacccgaagggcctggaggaacgtgtcgagaaatggctgaaggagtgcggtgttgaccggctcaagagaatggcaatcagcggggacgactgcgtggtcaagcccctggacgagcggttctccaccagcctcctcttcctgaatgacatgggcaaggtgcgcaaagacatcccgcagtgggagccctccaaagggtggaagaactggcaggaagtacccttttgttcccaccatttccacaaaatctttatgaaggatggccggtccctggtcgtcccctgtcgcaaccaggacgagctcatcgggagggcccggatttctcagggcgccggctggtcgctaagagagaccgcctgcctggggaaggcctatgcgcagatgtggagcctcatgtacttccatcgccgtgatctgcggttggcatccatggcgatctgcagcgccgtgccgaccgagtggttccccacaagccgcaccacctggtccatacatgcccaccaccagtggatgaccacggaggacatgctcaaggtctggaacagagtgtggatcgaggacaacccgaacatgaccgacaaaacccccatccacagctgggaagacataccatacctgggcaagcgcgaggacctgtggtgtggctccctcatcggactgagctcccgggcgacctgggccaagaacatccacactgccatcacccaggtgcggaacctgattggcaaggaggagtacgtcgattacatgcccgtaatgaagcgatacagcgccccctccgagagcgagggcgtgctataa

SEQ ID NO: 26295 - RNA, 9867 nt, synthetic construct
  misc_feature 1..9867: note = derived and/or modified CDS sequence (opt11) from DENV-4__KC762698__SS-prME
  source 1..9867: mol_type = other RNA
agcaccatgaccctgctctgcctgatccccaccgtgatggccttccacttaagcacccgggatggcgagccgttgatgatagtggcgaaacacgagcgggggcggcccctgttattcaaaaccaccgagggcatcaacaagtgtactctcatcgccatggacctaggggagatgtgcgaggacaccgtgacttataagtgccccctgctggtcaataccgagcctgaggacatagtgtgctggtgcaatctgacgagcacctgggtcatgtacggaacctgcactcaatccggggagcggagacgggagaagcgcagcgttgccctcaccccgcactcgggcatgggtctcgagacccgggccgaaacctggatgtcctccgagggtgcctggaagcatgcccagcgcgtggaaagctggattctgcggaaccccggctttgcgttgttggcgggcttcatggcgtacatgatcggccagacggggatccagcgcaccgtgttctttgtgctgatgatgctcgtcgccccttcctacggcatgcggtgcgtgggcgtggggaaccgcgacttcgtggagggagtgagcgggggtgcgtgggtggacctcgtactggagcacggagggtgtgtcaccaccatggcccagggtaagcccacgctcgacttcgagctcaccaagaccactgcgaaggaagtcgcacttctgcgtacttactgcatcgaggcctcgatcagcaacattacgacggcgacccgatgcccaacacagggagagccgtacctcaaggaggagcaggaccagcagtatatctgccgccgcgacgtcgtggatcgagggtgggggaatggctgcggcctgttcgggaagggcggggtggtaacctgcgcgaaattcctgtgctccggcaagattacagggaacctcgtgcagatagagaacctggagtacaccgtcgtcgtcacggtccataacggcgacacccacgccgtgggcaacgatactagcaaccatggagtgacagccaccataacgccccgctccccgagcgtcgaggtgaagctgccggactacggcgagctgacactggactgcgagccacgaagtggaatagacttcaatgagatgatccttatgaagatgaagaagaaaacgtggctcgtgcacaagcaatggttcttagacctgcctcttccatggaccgccggcgcggacaccagcgaggtccactggaactataaggaaagaatggtgacgttcaaagttcctcacgccaagcgacaggatgtcaccgtactggggtcgcaggagggcgctatgcatagcgccctggctggagcgaccgaagtagacagtggggacggaaaccacatgttcgccggccatctcaagtgtaaggtcaggatggagaaactgcgcataaaagggatgtcctacacaatgtgcagcggcaagttcagtatagacaaggagatggctgaaacgcagcatgggaccaccgtcgtgaaagtcaagtacgaaggcgccggggcaccctgtaaggttcccattgagatccgcgacgtgaacaaagagaaggtcgttggccgcatcatttcttccaccccctttgcggagaacaccaattccgtgaccaatatcgagctggagcccccatttggggactcctacatcgtcatcggcgctggcgactccgccctcacactgcactggttccggaaggggtcctcgatcgggaagatgttcgaatccacctaccgcggagcaaagcgcatggcgattctgggagagacggcctgggacttcgggagcgtgggtggcctcttcacctccctggggaaggccgttcaccaggtcttcggatcagtgtataccaccatgtttgggggcgtttcctggatgatccgcatcctgatcgggttcttagtcctctggatcggcacgaacagccggaacacatccatggccatgacctgcatcgcagtgggcgggatcacgctgttcttgggcttcacggttcaagccgacatggggtgcgtcgtaagctggaacggcaaggaactcaagtgcgggtccggcatcttcgtggtcgacaatgtgcacacatggaccgaacagtacaagttccagcccgagagccccgcccgcctggcctcagctatcctgaacgcccacaaggacggcgtgtgtgggatccggtccactacgcgcctcgaaaatgtcatgtggaagcaaataaccaacgaacttaactacgtgctatgggagggcgggcacgacttgaccgtcgtcgcgggcgacgtaaaaggagtgttgaccaaagggaagcgggcactgacgccgcccgtgaacgacctcaagtactcatggaagacatggggcaaggccaagatcttcacgcccgaggcccgcaactccactttcttgatcgacggtcccgacacgagcgaatgcccgaacgagcggcgcgcctggaatttcttcgaggtggaggactacggcttcgggatgtttacgaccaacatttggatgaagttccgcgaggggtccagcgaggtatgcgaccacagactgatgtccgccgccatcaaagaccagaaggccgtccacgccgacatgggctattggattgagagctccaagaaccagacctggcagatcgagaaggcgagcctaatcgaggtgaagacatgcctatggcccaagacccacacgctgtggtccaacggggtgttagagagccagatgttgatcccgcgttcctacgccggccccttcagccagcacaactaccgacaggggtacgccacccagacggccggaccctggcacctggggaagctggagatcgacttcggagagtgccccggcaccacagtaaccatccaggaggactgcgaccaccgggggccttccttgagaaccacgaccgccagcggcaagctggtcacccagtggtgttgccgctcctgcaccatgccgcctctgcggttcctgggggaggatgggtgctggtacgggatggagatccgaccactaagtgagaaggaagagaacatggtcaagtcacaggtcacggcgggccagggcacttccgagaccttctcaatgggcctcctgtgtcttacattgttcgtggaagagtgcctgagacgcagggtcacgcgcaaacatatgatactggtagtggtcatcaccttttgtgccattatcctcggcgggctgacctggatggacctgctccgggcgctcatcatgctaggcgatacgatgtccggacgcataggaggacagatccacctcgcgattatggccgtgttcaagatgagccccggctacgtgttgggcgtcttcttaaggaaactcacttcccgcgaaaccgcgctcatggtgatcgggatggccatgaccaccgtattctcgatcccgcatgacctgatggagctgatcgacggcatctcccttggcctgatcctcctgaagatcgtcacacacttcgataatacccaggttgggaccctggctctcagcctgacatttattcggtccacaactcctctggtgatggcctggagaacgatcatggccgtcttcttcgtggtgaccctcatcccgctgtgccggacaagttgtctacagaagcagagtcactgggtcgagatcaccgcgttaatcttgggcgcacaagcactacccgtctatctaatgacactcatgaaaggggctagtcgcagatcgtggccgctcaacgagggcatcatggcggtagggctcgtcagcttgttgggctccgccctcctcaagaacgacgtcccgctggccggccccatggtcgcagggggactcttactggccgcttatgtaatgtcagggagttccgccgacctctccctggaaaaagcggctaacgttcagtgggacgagatggctgacatcacagggagcagccccatcatcgaggtgaaacaggacgaggatggttccttttccatccgcgacgtcgaggagacgaatatgatcaccctcctcgtgaagctcgcgctgatcaccgtgtccggcctatacccgctggccattcccgtgaccatggccttgtggtatgtgtggcaggttaagacccagcggagcggcgccctctgggacgtcccctcccctgcggcgacccagaaagccaccctgagtgagggtgtataccgcatcatgcaaaggggcctgttcgggaagacccaggtaggcgtgggtatccacatggagggcgtgttccacaccatgtggcacgtgacgcgcgggtcagtcatctgccatgagacggggcggctcgagccgagctgggcagatgtgcgcaatgacatgattagctacggcggaggctggcgcctgggcgacaagtgggacaaagaagaagacgtgcaggttctggccattgagcccgggaagaaccccaaacacgtgcagaccaagcccggcctgttcaagactctgacgggagaaatcggagccgtgaccctcgatttcaaacctgggacctctggcagccccatcatcaacaagaagggcaaggtcatcgggctttacggcaacggagtcgtgaccaagagcggcgattacgtttcggcgataacgcaggctgaacgaatcggagaaccagactacgaggtagacgaggacatattcaggaaaaagcggctgaccattatggacctgcacccgggcgcaggtaaaacaaagcgcatcctccccagcattgtacgcgaggccctgaagcgcaggctgcgcacactcatcctggcgcctacgcgggttgtagccgccgagatggaggaggccctgcgagggctgccgattcggtaccagaccccggccgtaaagtccgagcacaccggaagagagatagtggacctcatgtgccacgcgacgttcactacccggctgctgagctctaccagggtgccgaattataacctcatcgtcatggacgaggcacacttcacagacccctgctcagttgccgcccgggggtacataagtacgcgcgtggagatgggcgaagctgcggcaatattcatgaccgccactcccccggggagcattgacccgttcccccagagcaatagtcccatcgaagacattgagcgcgagatcccggagcgcagctggaacaccggattcgactggattacggactaccagggcaagaccgtctggttcgtgccctccatcaaggccgggaacgacatcgccaactgcctcaggaagtcagggaagaaggtgatccagctctcccgcaagacgttcgacacagagtaccccaagacaaagctcacggactgggacttcgttgtcaccaccgatatatcggaaatgggggcgaacttccgtgccggccgggtgatcgacccccggcggtgcctgaagccggtcatcttgacggacgggcccgagcgcgtgatcctcgccggccctatacctgtgacaccggcctccgccgcccaaagacgcggccgaatcgggcgcaaccctgcccaggaagacgaccagtacgtgttcagcggcgaccctctgaaaaacgacgaggaccacgcacactggactgaggcaaagatgctgctggacaatatctacacccctgaggggatcataccgacgctgtttggcccggagcgagagaaaacccaggcgatcgatggagagttccgtttaagaggggaacagagaaaaaccttcgtggagttaatgcggcgcggagacctgccggtctggctttcgtacaaggtcgccagcgccgggatatcctacaaggaccgagagtggtgtttcaccggtgagagaaacaaccagatccttgaagagaacatggaggtggagatatggacccgggagggggaaaagaagaaactgcgcccgaagtggctcgacgcgagagtgtacgccgaccctatggcgctaaaagacttcaaagagttcgcgagcggccgcaagtccatcacccttgacatcctgaccgagatagccaccctccccacctacctgagctccaaggccaagctggccttagacaatatcgtcatgttacatacgacagagaagggtggacgggcctaccagcatgcactcaacgagttgcccgagagcctcgaaaccctgatgctcgtcgcactgttgggcgcgatgaccgcggggatcttcctcttctttatgcagggcaagggcatcggcaagctgtccatgggcctgatcgccatagctgtggccagcggcctcctgtgggtcgccgagatccagccacaatggatcgccgcctccattatcctcgagttcttcttgatggtgcttttgatacctgagcccgaaaaacagcggacgccacaggacaaccagctcatctacgtgattctgaccatactgaccattatcggcctcatcgccgcaaacgagatggggctgatcgagaaaaccaaaacagacttcggcttctatcaggttaagaccgagaacaccatccttgacgtggacctccggccggccagcgcttggactctgtacgccgtcgcaacgaccatcctgacgcctatgctgcggcacaccatcgagaacacgagcgcgaatctgtccctggcagctattgccaaccaggcagcagtcctgatggggctagggaagggctggcccctacacaggatggatctgggggtcccactgcttgccatggggtgttacagccaagtgaacccgaccacactcacagcctcattagtcatgctactcgtgcactatgccattatagggcccggtctgcaagcaaaggccacgagggaagcgcagaagcgcaccgccgccggcatcatgaagaaccccactgttgacggtataactgtcattgacctggaacccatctcgtatgacccgaagttcgaaaagcagctcggacaggtgatgctgctggttctctgcgtgggacagctgctgctcatgagaaccacctgggcactgtgcgaggtactgacgttagccaccggacccgtgatgactctatgggaagggaaccctggccgattctggaacaccaccatcgcggtatccaccgcaaacatattccggggaagctatctggccggggccggcctcgctttctccctgataaagaatgcacaaacgccaaggcgggggaccggcaccaccggggagacgctgggggaaaagtggaagcgccagttaaactcactggaccgaaaggagttcgaggagtacaagagatctggcatcctggaggtcgaccgtaccgaagctaagagcgccttacgcgatggctccaagataaaatatgccgtgagcagaggctcctcaaagatcagatggatagtagagcgagggatgatcaagccaaagggcaaggttgtggacctgggatgcggtagaggcgggtggagttactatatggccacgctgaagaacgtcaccgaggtcaaaggttacacaaaaggcgggcccgggcacgaagaacccatccccatggcgacatatggctggaacctcgtgaagctgcatagcggcgtggacgtgttctataagccaaccgagcaggtcgataccctgctctgcgacatcggcgagagctcgtccaaccccactatcgaagaaggccgaacacttcgcgtcctgaagatggttgaaccctggttgagcagcaagcccgagttttgcataaaagtcttaaatccctacatgccgaccgtgatcgaggagctggagaagctgcaacgccgccacggtgggtccctggtgaggtgtcccttgagccgtaattccacacatgagatgtattgggtcagcggcgcgtccgggaacatcgtatcttcagtgaacaccattagcaagatgctgctcaaccgctttacgacccggcaccgcaagcccacgtatgagaaggacgtcgacctgggtgcggggacccggtctgtgagcacggagatcgagaagcccgacatgaccatcatcggccgccggctgcagcgcctacgggaggagcacaaggagacttggcattacgatcacgagaatccctacagaacctgggcctaccacggctcgtacgaagcgcccagcacgggttcagcctcatccatggtgaacggcatcgtcaagctgttgaccaagccgtgggatgtgatacccatggtgactcagctcgccatgaccgacacgaccccttttggtcagcagcgggtcttcaaagagaaggtggatacccgcacaccccagcccaagcccggcacgcggatgatcatgacgaccaccgccaactggctatgggccctgctcgggaagaaaaagtcccctcgcctatgtacgcgggaggagttcatcagcaaggtgcgctctaatgcggcaataggcgcagtctttcaggaggagcaggggtggacctccgcttctgaagccgtcaacgactcaagattctgggagctggtagacaaggagcgagcgctccaccaggagggcaagtgcgagtcctgcgtgtataacatgatgggaaagcgggagaagaagctgggggagttcggcagagccaaaggcagccgcgccatctggtacatgtggctgggtgccaggttcctggagttcgaggccctgggcttcctgaacgaggaccattggttctcccgagagaatagctggagtggcgtggagggcgaggggctccaccggctggggtacatcctggaggacattgacaagaaggatggggacctcatctacgctgacgataccgccggctgggacacgcgcatcacggaggacgacctgttgaacgaagaactcatcaccgagcagatggcgccccatcacaagaccctggcgaaggcgatcttcaagctgacgtatcagaacaaggtcgtcaaggtgttacgtcccacgcccaagggtgccgtgatggacatcatctcacgcaaagaccagcgcgggtccggccaagtcgggacctacggacttaacacctttaccaacatggaggtgcagttgatccgccaaatggaggccgagggggtgatcacgcaagacgacatgcagaacccaaaaggtctcaaggagagagtcgagaagtggctgaaggagtgtggcgtagaccgtctggagcgcatggccatcagcggggacgactgcgtcgtcaagcccctagacgagcgcttttcgaccagcctgctgttccttaacgacatgggaaaggtacggaaagacatcccccagtgggagccgtccaaggggtggaagaactggcaggaagtgcccttctgtagccatcatttccacaagatcttcatgaaagatggcagatctcttgtcgtgccctgtcggaatcaagacgaattaataggccgcgcccgaatcagccagggcgcaggctggtccttgagggagacggcctgcctagggaaggcatacgcccagatgtggctgcttatgtacttccaccggcgcgacctgcgcctggcctctatggcgatatgctccgcagtaccgaccgaatggttcccgacctcgcggacgacatggagtatccacgcccaccaccagtggatgaccaccgaggacatgctcaaggtctggaacagggtgtggattgaggataacccgaacatgacggacaagacccccgtgcactcctgggaagatatcccttacctgggcaagcgggaggacttgtggtgcggaagcctcataggcctctccagccgcgccacctgggccaagaacatccacactgcgatcacacaggtccggaacctaattggaaaggaggagtacgtggactatatgcctgccatgaagcgctactccgcccccttcgagtctgaaggcgtgctctag

SEQ ID NO: 26296 - RNA, 9867 nt, synthetic construct
  misc_feature 1..9867: note = derived and/or modified CDS sequence (opt11) from DENV-4__KC762699__SS-prME
  source 1..9867: mol_type = other RNA
agcactatgaccttgttatgcttaatacccaccgtgatggccttccacctgagcaccagggacggtgagcctctcatgatcgtggcgaagcacgagcgggggcgccccctgctcttcaagaccacggagggcatcaacaagtgcacgctcatagctatggacctgggggagatgtgcgaggacaccgtgacctacaagtgccccctgctcgtgaacaccgagcccgaggatatcgactgctggtgtaaccttaccagcacctgggtgatgtacgggacttgcacccagtccggtgagcggcgccgcgagaagcgcagcgtcgccctgaccccgcactctggcatgggcctcgaaacccgggccgagacctggatgagctccgagggggcctggaagcacgcccaacgcgtggagagctggatcttaaggaatcccggcttcgcgctgctcgctgggttcatggcctacatgattggacaaacagggatccaaaggacggtgttctttgtgctgatgatgttagtggccccctcctacggcatgcggtgcgtcggcgttgggaatcgcgacttcgtggagggagtcagcgggggcgcgtgggtggacttggtgctggagcacggcgggtgcgtcacgaccatggcccaaggcaaacccaccctggacttcgagctcacgaagaccaccgcaaaagaggtggccctgctacgcacctactgcatcgaagccagtatctcgaacattacgaccgctacgcgctgcccgacccagggggagccctacctcaaggaggagcaggaccagcaatacatctgccggcgcgacgtggtcgaccggggctgggggaacggatgtggcctgttcgggaagggtggggtcgtgacttgcgctaagttcctatgttccggcaagatcaccgggaatctcgtccagatcgagaacctggagtacaccgtggtggtcaccgtgcacaacggcgacacgcacgccgtcggcaacgacaccagcaaccacggggttacagccaccatcacgccccgctcccccagcgtcgaggtcaagctgcctgattatggcgagctcaccctggactgcgagccacggtccggcatcgacttcaacgagatgatcctgatgaagatgaagaagaagacctggctcgtgcacaaacagtggttcttagacctgcccctcccttggaccgccggcgcggacaccagcgaggtgcactggaactacaaggagcgcatggttaccttcaaggtgccgcatgccaagcggcaggacgttaccgtacttgggtcccaggaaggcgccatgcacagcgccctggctggcgcgaccgaggtggacagcggggacggtaaccacatgttcgccgggcacctcaagtgcaaggtgaggatggaaaagctgagaatcaagggcatgtcgtacacaatgtgcagcggcaagttctccatcgacaaggagatggcggagacgcagcacggcaccaccgtcgtgaaggtgaagtacgagggcgccggggccccctgcaaggtccccatcgagatccgggacgtaaataaggagaaggtggtcggccgcattatctcgtccacccccttcgcggagaacacgaacagcgttaccaacatcgagctcgagccgccgttcggagatagttacatcgtaatcggcgtcggcgacagcgcccttaccctccactggttccggaagggttccagcataggcaagatgttcgagtccacttaccgcggggccaagagaatggctatcctgggcgagacggcgtgggacttcgggagcgtgggtggcctcttcacctctctggggaaggccgtgcaccaggtcttcggcagcgtgtacaccacgatgttcgggggtgtgtcctggatgatccgcatcctgatcgggttcctcgtcctttggattggaacgaatagccggaacacctccatggccatgacctgcatcgccgtgggggggattacgcttttcctgggcttcacggtgcaggccgacatggggtgcgtcgtgagctggaacggcaaggagctcaagtgtgggtccggcatcttcgtggtggacaacgtacacacctggactgagcagtacaagtttcagcccgagtcgcccgcacgcctggcaagcgccatcctgaatgcccacaaggacggcgtgtgcgggatccggtcaaccacgcgactagagaacgtcatgtggaaacagatcaccaacgagctgaactacgtgctgtgggagggcggccacgacctcaccgtcgttgccggcgacgtaaagggcgtgctaaccaaggggaaacgggcgctgacgccgcccgtcaacgacctcaagtacagctggaagacctggggcaaggccaaaatcttcacgcccgaggcccgcaactccacctttcttatcgacgggcccgacaccagcgagtgcccgaacgagcggcgcgcgtggaactttttcgaggtggaggactacggcttcgggatgttcaccaccaacatatggatgaagttccgggagggctccagcgaggtctgcgaccaccgcctgatgtccgccgcgatcaaggaccaaaaggctgtgcatgccgacatggggtactggatcgaaagttccaagaaccagacatggcaaatagagaaggcgagcctcatcgaggtgaagacgtgtctgtggcccaaaacccacactttatggtccaatggggtactcgagagccagatgcttatcccccggtcctacgcgggcccgtttagccagcacaactaccgccaggggtacgccacccagaccgccggcccctggcacctggggaagttagagatagacttcggagagtgtcccggcacaaccgtaaccatccaggaggactgcgaccaccggggtcccagcctgcgcaccacgaccgcaagcggcaaactcgtgacccagtggtgctgcaggtcctgtaccatgccgcccctccggttcctgggggaggacggctgctggtacgggatggagatccgcccactgagcgagaaagaggagaacatggtcaagagccaggtcacggctggccagggtacctccgagaccttcagtatgggactcctgtgcctgaccctcttcgtggaggagtgcctgcggaggcgggtcacgcgcaagcacatgatcctggtggtggtcatcaccttttgcgcaatcatcctcggcgggttgacatggatggacctgctccgggccctgatcatgctgggagacaccatgtccggtcgtatcggtggccagatccacctcgcgatcatggcggtgttcaagatgagccccggatacgtgctgggcgtcttcctgcggaagctcacgtcgcgcgaaacagccctaatggtcatcgggatggccatgactaccgtgttcagcatcccgcacgagctgatggaactcatagacggtatctccctgggcctgatcctactgaagatcgtcacgcacttcgacaacacccaggtggggaccctggccctcagcctgaccttcatccggtcaacgacgcccctggtgatggcctggcgcaccatcatggccgtcttctttgtggtgaccctcattcccctttgccggacgagctgtctgcagaagcagtcccactgggtcgagatcaccgccttgatcctgggcgctcaggccctgcccgtgtacttaatgacccttatgaagggggccagccgtcggtcctggccgctgaacgagggcatcatggccgtggggctcgtgagccttctgggctccgcactcctgaagaacgacgtcccgctggccggccccatggtagccggcggactactgctggccgcctacgtcatgagcggatccagcgcggatctctccctggagaaggccgccaacgtgcagtgggacgagatggccgacatcaccggcagcagccccattatagaggtgaagcaggacgaggacgggtccttcagcataagagatgtcgaggagacgaacatgatcacccttctagtgaagctggccctgatcaccgtgtccggcctctacccgctggcgatccccgtcaccatggccctttggtacgtatggcaggtcaaaacgcagcggtccggcgccctctgggacgtaccctcccccgccgccactcagaaggcgaccctgagcgagggggtgtaccgcatcatgcagagaggcctgtttggtaagacccaggtgggggtcggtatccatatggagggcgtgttccacacgatgtggcacgtgacgcgcggctccgtcatttgccacgaaaccggacgactcgagccgagttgggcggacgtgcgcaacgatatgatctcctacggcgggggctggcgcctgggcgacaaatgggacaaggaggaggacgtgcaggtcctggccatcgaacccgggaagaaccccaagcatgtgcagaccaagcccggtctcttcaagacactgacgggggagataggcgcagtgaccctggacttcaagccggggactagcggctcgcccatcatcaacaagaagggcaaggtcatcgggctctacggcaacggcgtggtaaccaagagcggcgattacgtctccgccatcacgcaggcggagcggatcggtgaacctgattacgaggtcgacgaggacatcttccgcaagaagcgactgaccataatggacctgcacccgggcgccggcaagaccaagcgcatactccctagcatcgtgcgggaagccctgaagcgccggctgcgcaccctcatcctggcccccacacgggtcgtggccgccgagatggaggaagccctgcgcgggctgccgatccggtaccagacaccggccgtgaagtccgagcacaccggtcgagagatcgtggacctgatgtgccacgccacctttacgaccaggctgttgtcgtccacgcgagtacccaattacaacctcatcgtcatggacgaggctcatttcaccgacccatgctctgtggctgccagggggtatatctccacgcgcgtggagatgggcgaggccgcggcgatcttcatgaccgccacacccccggggtcaatcgatcctttcccccagagcaactccccaatcgaggacatcgagcgggagatcccggagcgctcgtggaataccggcttcgactggatcacggactatcagggcaagaccgtctggttcgtgccctccatcaaagctgggaacgatattgccaactgcctgcgcaagagcggcaagcgcgtgatccagctgtcccgcaagacgttcgacacggagtaccccaagacgaagctcaccgactgggactttgtcgtgaccactgatatcagcgagatgggggccaacttccgggcgggccgcgtgatcgacccccggcgctgtctgaagccggtcatcctgacggacgggcccgagcgggtgatcctagccgggcctatccccgtaaccccggcgtccgccgcgcaacgccgtggccgcatcgggcggaacccagcgcaggaggacgatcaatacgtcttcagcggcgacccgctgaagaacgacgaggaccacgcccactggaccgaggccaagatgcttctcgacaacatctacacccccgagggtatcatcccgacgctgttcggacccgagcgcgagaagacccaagccatcgacggcgagttccggcttcgcggggagcagcggaagaccttcgtagagctcatgagacggggcgacctgcccgtgtggctgtcctacaaggttgcgtctgccgggatcagttacaaagaccgcgaatggtgcttcaccggtgagagaaacaaccagatcctggaggagaacatggaagtggagatctggacgcgcgagggggagaagaaaaagctgcggcctaagtggctggacgcccgcgtgtacgccgacccgatggccctcaaggacttcaaggagttcgctagcggccggaagtccatcaccctggacatcctgaccgaaatcgccaccctccccacctacctgagctccaaagccaagctggccctcgacaacatcgtcatgttacacacgaccgagaagggcggacgagcctaccagcacgcgctgaacgagctccccgagagcctggaaaccctgatgctagtggccctactaggcgccatgaccgccgggatcttcctcttcttcatgcagggcaaggggattggcaagttgtccatgggcctgatcgcgatcgccgtggcctccggattgctgtgggtggccgagatccaacctcagtggatcgctgcgtcgattatacttgaattcttcctcatggtgctgttaatccccgagcccgagaagcagaggacgccccaggacaaccagctcatctacgtgatattgaccatcctgaccatcatcggcctcatcgccgccaacgagatggggctgatcgagaagactaagacggactttggcttctaccaggtcaagaccgagaccactatcctggacgtggatttacggccggctagcgcctggactctgtacgcggtggccacgaccatactcacccccatgctccgccacacaatcgagaatacctccgccaacctgagtctagcggccatcgcgaaccaggccgccgtcctcatggggctgggcaagggctggcccctgcaccgtatggacctcggggtgcccctgctggccatgggctgttacagccaagttaacccgaccaccctcacagccagtctggtcatgctgctcgtgcactacgcgataatcgggccaggcctgcaagctaaggccacccgcgaggcccagaagcggaccgcggccggcatcatgaagaaccccaccgttgacgggatcacagtcatcgacctggagcccatcagctacgacccgaaattcgagaaacagctcggccaggtgatgctgctggtgctctgtgtcgggcagctgctgctcatgagaaccacctgggccctgtgcgaggtgctaaccctcgccaccggccccgtcatgaccctctgggaggggaaccccggcaggttctggaataccaccatcgccgtcagtacggcgaacatcttccgcggatcgtacctggctggggccggcctcgccttctccctcatcaagaacgcgcagacgccccggcgcgggaccggcaccacgggggagaccctgggcgagaagtggaagcggcaactgaatagcctggaccgcaaggagttcgaagaatacaagcggtccggcattctcgaggtggaccgcaccgaggcaaagagcgccctccgggacgggtccaagataaagtacgccgtgagccgcggctctagcaagatccggtggatcgtcgagagaggcatgatcaagccgaagggcaaagtagtggaccttgggtgtggccgcggggggtggtcctactatatggcgaccctgaagaacgtaaccgaagttaagggctataccaaggggggccccgggcacgaggaacctatccccatggccacctacggctggaacctcgtgaagctacacagcggcgtggatgtgttctacaagccgaccgagcaggtcgacaccctgctctgcgacatcggggagtccagctcaaaccccacgatcgaggagggccgcaccctgcgcgtactgaagatggtggaaccctggctctcaagcaagcccgagttctgcatcaaggtcctgaacccgtacatgcccaccgtgatagaggagctggagaagctccagcggcgccatgggggctccttggtgcggtgccctctgagccgcaactccacccacgagatgtactgggtctcgggcgcgtccgggaacatcgtgagctccgtgaacacgatatccaagatgctgctcaatcggttcaccacccgccaccgcaagcccacctatgaaaaggacgtcgacctgggcgctgggacacgctccgtgagcacggagaccgagaagcctgacatgaccatcatcggccggagactgcagcggctacgcgaggagcacaaggagacgtggcactacgaccaggagaatccctaccggacctgggcctatcacgggtcctacgaggcccccagcactggctccgcgagcagtatggtgaacggcgtcgtgaagttgctgaccaaaccgtgggacgttatccccatggtcacacaactcgccatgaccgacaccacccccttcgggcagcagcgcgtgttcaaagagaaggtggacacgcggacgccccagccgaagccgggcacccgcatgatcatgaccaccaccgccaactggctgtgggccctgctcgggaagaagaagtccccgcggctgtgcacccgcgaggaattcatttccaaggtcagaagcaacgccgcgatcggcgccgtgttccaggaggagcaggggtggacctccgccagcgaggccgtgaatgacagcagattctgggagctggtcgacaaggagcgggccctccaccaggagggcaagtgtgagtcctgtgtgtacaacatgatgggcaagcgcgagaagaagcttggggagttcggccgcgccaaggggtcgcgggccatctggtatatgtggctgggcgcccgcttcctcgaattcgaggccctggggttcttgaacgaggaccactggttcagccgggagaacagctggtccggagtggaaggcgaggggctccaccgtctgggctatatcctggaggacatcgacaagaaggacggggacctcatctacgccgacgacacggcgggctgggatacccggatcacagaggacgacctgctgaacgaggagctcatcaccgagcagatggcgccccaccacaagacactggcgaaggccatcttcaagctgacctaccaaaacaaggtcgtaaaggtgctccgccccacccctaagggcgcggtcatggacatcatcagccggaaggaccagcgcggttccggccaagtggggacctacggcctgaacacctttacgaatatggaggtgcagctgattcggcagatggaggccgagggggtaatcacgcaggacgacatgcagaaccccaagggcctcaaggagcgcgtggagaagtggctgaaggagtgcggcgtggatcggctgaagcgcatggccatcagcggggacgactgcgtcgtaaagcccctagacgaacggttctccaccagcctgctgtttctcaatgacatgggcaaggtgcgcaaggacatcccacagtgggagccctccaaggggtggaagaattggcaggaggttcccttctgcagccaccacttccacaagattttcatgaaggacggtcgatccttagtggtgccctgccgcaaccaggacgagctgattggccgggcgagaatcagtcagggggccggctggtccctacgggagaccgcgtgcctgggcaaggcctacgcccagatgtggagcctgatgtacttccaccgccgcgacctccggctggcctccatggctatctgcagcgcggtcccgacggagtggttcccgaccagccggaccacctggtccatccacgcacatcaccagtggatgacgaccgaggatatgctgaaggtttggaaccgggtatggatcgaggacaaccccaacatgaccgacaagacccctgtccacagctgggaggacattccgtacctcggcaaacgcgaggatctgtggtgcggatctctgattggtctcagcagtcgggccacttgggcaaagaacatccataccgccatcacccaagttcgcaacctgatcgggaaggaggaatacgtggactacatgcccgcaatgaagcggtacagcgcccccttcgagtcggagggagttctgtaa

SEQ ID NO: 26297 - RNA, 9867 nt, synthetic construct
  misc_feature 1..9867: note = derived and/or modified CDS sequence (opt11) from DENV-4__JQ915085__SS-prME
  source 1..9867: mol_type = other RNA
tcgaccatgactctgctctgcttaatccccaccgtgatggccttccacctgagcacgcgcgacggagaaccgctgatgatagtggccaagcatgaacgggggcgacctttattattcaagaccaccgaagggatcaataagtgcaccttgattgctatggacttgggtgagatgtgtgaggacaccgtgacgtataagtgccccctcctcgtcaatacggagcccgaagatatcgattgctggtgtaacctcaccagcacttgggttatgtacgggacgtgcacccagtccggggaacggcgccgggagaagcgctcagtcgccctgaccccgcattccggcatggggctcgagacccgggccgaaacttggatgagttcggagggggcctggaagcacgcccagcgcgtggaaagctggatcctccggaaccccggcttcgcgttacttgccgggttcatggcgtacatgattggccagaccggtatacagaggactgtcttcttcgtgctgatgatgttggtggccccctcgtatggcatgcggtgcgtaggcgtagggaacagagacttcgtagagggcgtcagcggaggcgcgtgggtggacctcgtgttagagcatggcgggtgcgtcaccacaatggcccagggcaaaccaaccctggacttcgagctcacgaaaaccaccgctaaggaggtggccctgctgcggacatactgcatcgaggcctctatctcaaacatcacgacagcgacccgctgtccgacccagggggagccatacctcaaggaggagcaggaccagcagtacatctgccggcgcgacgtggtcgaccggggctgggggaacggctgcggactgttcgggaaaggcggcgtagtaacctgcgccaagttcttatgctccggcaagatcaccgggaacctcgtccagatcgagaacctagagtacaccgtggtggtcaccgtgcacaacggggacacgcacgccgtcggcaacgacaccagcaaccacggggtcaccgccaccatcacgccccgatcccccagcgtggaggtcaagctccctgactacggcgagctcaccttggactgtgagccccggtcggggatcgacttcaacgagatgatactgatgaaaatgaaaaagaagacatggctcgtgcacaagcagtggttcctggacctgccccttccctggaccgccggcgccgacaccagcgaagtgcactggaactacaaggagcgcatggtaacgttcaaggtgccgcatgccaagcgtcaggatgtaaccgtcctgggctcgcaggagggagccatgcacagcgccctggccggagcgaccgaagtggatagcggggacggcaaccacatgttcgccgggcacctgaaatgtaaggtccgcatggagaagttaagaatcaagggcatgtcctacaccatgtgtagcggtaagttcagcattgacaaggagatggccgagacgcagcacgggactacggttgtgaaggtgaagtacgagggcgccggggccccatgcaaagtcccgattgagatccgggacgtgaacaaggagaaggtcgtaggccgcatcatcagctccacgccctttgcggagaacacgaatagcgtgaccaacatcgagttagaaccgccgttcggagactcctacatcgtgatcggagtcggcgactcggccctcacactgcattggttccggaagggttccagcatcggcaagatgtttgagtccacttaccgcggagccaagcgtatggccatcctgggcgaaactgcgtgggacttcggaagcgtgggaggcctcttcacatccctggggaaagccgtgcatcaggtcttcggctcggtgtacacgaccatgtttgggggagtgagctggatcatccgcatactgatcgggtttttggtcctgtggatcggaacgaacagccggaacacttccatggccatgacctgtatagccgtaggcgggatcaccctgttcctggggtttacggtccaggccgacatgggatgcgtcgtgagttggaacgggaaggagctcaagtgcggctctggaatcttcgtggtggacaacgtgcatacctggaccgagcagtacaaattccagccggaaagccccgcgcgcctggcgtcggctatcctgaacgcccacaaagacggtgtttgcgggatacggagtaccacgaggctcgagaacgttatgtggaagcagatcactaacgagctgaactacgtgctgtgggagggtgggcacgacctgaccgtggtcgccggtgacgtcaagggtgtgttgaccaaggggaaaagagcgttaacgccgcccgtcaatgatctcaagtacagctggaaaacctgggggaaggccaagatcttcacccccgaagcccgcaattctacatttttgatcgacgggccggacacgtcggagtgcccgaatgagcggcgcgcctggaactttttcgaggtggaggattacggcttcgggatgttcaccacaaatatatggatgaagttccgggagggctcctcagaggtgtgcgaccaccgcttgatgtccgccgcgatcaaggaccagaaagcagttcacgctgacatgggctactggatagagagctctaagaaccagacgtggcagatagagaaggcctcattaatcgaggtcaagacgtgcctctggcctaagacccacaccctgtggtctaacggtgtcttagagagccaaatgctgatccctaggtcctacgcgggcccgttcagccagcacaactataggcaggggtacgcgacccagacggcgggtccgtggcatctcgggaagttggagatcgacttcggcgagtgcccaggcaccacagtcactatacaggaggactgcgaccaccgggggccctcactgcgaacaacgaccgccagcggcaaactggtcacccagtggtgctgccgctcctgcaccatgccgccgttgaggttcttgggggaggacggctgttggtacgggatggagatcaggccgctaagcgagaaggaggagaacatggtcaagagccaagttacggccggccaaggcacctccgaaacctttagcatggggttactgtgcctgaccctctttgttgaggaatgcctgcggcgacgggtcacgcgcaagcacatgatcctggtcgtggtcataaccttttgcgcgataatcctcggcggcctgacgtgggtggacctactccgagccctgatcatgttgggcgacaccatgtccgggagaatcgggggccagatccatctcgccattatggccgttttcaagatgtcacccggatacgtcctgggggtgttcctgcggaagctcacgagccgggagaccgccctcatggtgatagggatggccatgactaccgtttttagcataccacgggatctgatggagctcatcgacggaatctcgctgggactgatcctcctgaagatagtgacgcacttcgataacactcaggtgggcacactggctctcagcctgaccttcatacggtccacgacgccactggttatggcctggcggaccatcatggtggtcttcttcgtcgtaaccttgattcccctgtgcagaacgagctgcctgcagaagcagtcccactgggtagaaattaccgccctcatactgggcgcccaagctctacccgtctacctcatgaccctgatgaaaggggcctcaagacgcagctggccgctgaacgagggcatcatggccgtgggactcgtgagcttacttggatccgcactcctgaagaacgacgttcccttagcgggccccatggtcgccggagggctcctgctagccgcctacgttatgtcagggtcgagcgccgacctcagtctggagaaggcggccaacgttcaatgggacgagatggctgacattaccggcagcagccccatcatcgaggtcaagcaagacgaggacgggtcctttagcatacgggacgttgaggaaacgaacatgatcacactgctcgtcaaattggccctaattactgtgtccggtctctacccgctggctatcccagtgaccatggctctttggtacatctggcaggtcaagacacagcgtagcggcgctctttgggacgtgccctcccccgccgcaattcaaaaggctaccctgtccgagggggtgtaccggatcatgcagcgtggtttgttcggcaaaacccaagtaggggtgggtatccacatggaaggcgtgttccataccatgtggcacgtcacccggggctccgtaatctgccatgagacggggcgcttagagccctcgtgggcggatgtgcgcaacgacatgatttcctatggcggcggctggcggctgggcgacaagtgggacaaggaagaggacgttcaggtgttggccatcgaacccggaaagaaccctaagcacgtgcagactaagcccggcctgtttaagaccctgaccggcgagatcggcgccgtcacgctggacttcaagcctgggacctcaggctcacccataattaataaaaagggcaaggtgatcgggctatacgggaacggcgtcgtaactaagtccggcgactacgtgtccgcaatcacacaggccgagcgcattggcgaacccgactacgaggtggacgaggacatctttcggaagaagcgcttgacgatcatggacctgcaccccggcgctggcaagaccaagaggatcctccccagcatcgttcgagaggccttgaagcgacgcttacgcacactcatcctggcccctacccgcgtggttgccgcggagatggaggaggccctgcgcgggctacccatcaggtatcagacgccggctgtcaaatccgagcacaccggccgggagatcgtggacctcatgtgccacgcaacgttcacgacgcgcctgctgagctccaccagggttccgaactacaacctcatcgttatggacgaggcccatttcacagatccctgctccgtggcggcgcgtgggtacatttccacccgggtcgagatgggggaggccgccgccatattcatgacggcgacgcccccgggcagcattgaccccttcccgcagagcaactcccccatcgaggacatcgagcgcgagattccggagcggtcatggaacacgggctttgattggatcacggactaccagggcaaaacggtgtggttcgtgccctcgatcaaggccggtaatgacatagccaactgcctacgcaagagcggcaagaaggtcattcaactttcccgcaagaccttcgacaccgaataccctaagaccaagctcacggactgggacttcgtggtgaccacggacatctcggaaatgggagccaacttccgggccggtcgagtcatcgatccccggcgctgtctgaaaccggttatacttacagacggccccgagagggtgatactcgcgggcccgatccccgtcaccccggcctctgccgcccagcgccggggccggatcggtaggaatcccgcccaggaggacgatcagtacgtgttcagcggcgatccgctcaagaacgacgaagaccacgctcactggaccgaggccaagatgctgctcgacaatatatatacccccgagggcatcatcccgacattattcggcccagagcgcgagaaaacgcaagccatcgacggcgagtttcgcctgagaggggaacagcggaagaccttcgtggagttgatgaggcggggtgacctgcctgtctggctcagctacaaagtggccagcgcgggaatcagttacaaggaccgcgagtggtgtttcaccggagaacgtaataatcagatcctcgaggagaacatggaggtggagatatggacccgcgagggagaaaagaagaaacttcggccgaaatggctcgacgcccgggtgtacgccgacccgatggccttaaaagatttcaaagagttcgcaagcggccggaagtccatcacactggacatcctgactgagatcgcgaccttgccaacctacctcagctccaaggcaaagctggcccttgacaacatcgtgatgttgcacactgccgaaaagggcgggcgcgcttaccagcatgcgctgaacgagttgccggagagtctggagacgctgatgctggttgccctgcttggtgccatgaccgccggtatcttcctcttcttcatgcagggcaagggaattgggaaactgagcatgggactgatcgcgatagccgtcgccagcgggcttctatgggtggccgagatccagccgcaatggatcgccgcgtccattatcctggagttcttcctcatggtcctactgatcccagagccggagaagcagcgcacgccccaggacaaccagctcatctacgtgatactcacgatactaacgatcatcggtttgatcgccgccaacgagatgggccttattgagaagaccaagaccgatttcggcttctatcaggtaaagaccgagacgaccatcctggacgtggacttgcggccggcctccgcctggactctgtacgcggtcgcaaccacgatcctgactcccatgctacgacatacaattgaaaataccagcgccaacctgtcgttagctgccatcgcgaaccaagccgcagtgctcatggggctgggcaagggctggccgctccacagaatggacttaggagtgccgctgctcgccatgggctgctacagccaggtcaatccgaccacactcactgcctccctggtgatgttgctcgtgcactacgcgatcatcggtccaggtctgcaagccaaagctacgcgcgaagcccagaaacggacggcagccggcatcatgaagaacccgactgtcgacggaatcacagtgatcgacctcgagcccataagctacgacccgaagttcgagaaacagttaggacaggtcatgcttttggttctctgtgtggggcagctgctgctcatgcgcaccacgtgggcactgtgtgaggtgctgacgctggccacaggccccatcatgaccctgtgggaggggaaccccggacggttctggaatacgaccatagccgtcagtaccgcgaacatcttccgcggcagctatctcgcgggggccggactcgccttctccctgatcaagaacgcccagacccctcgtcgcggtactggcaccacgggggagaccctgggcgagaagtggaagcgacagctgaactctctggaccgaaaggagtttgaggagtacaagcgatccgggatcctggaggtagaccgcacggaagccaagagcgccctccgggacgggagtaagatcaaacacgccgtgtctcgcggaagctctaagattcgctggatagtcgaacgcgggatgatcaaaccgaaggggaaagtggtagacctgggctgcggacggggcgggtggtcctactacatggccactctgaagaacgtcacggaggtgaagggctatacaaaaggtggtcccggccacgaggagccgatccccatggccacctacggctggaacctcgtgaagctgcactcaggcgtcgacgtgttctacaagccgacggaacaggtcgacactctgctctgtgacattggcgagtccagctccaaccccaccattgaggagggccgcaccctccgcgttctgaagatggtggagccctggctatcgagcaagcccgagttctgcattaaggtgctcaacccatacatgccaacggtgatcgaggagctggagaaattgcagcggcgccacggtggatccctcgtgcggtgccctctgagccggaactccacccacgagatgtactgggtcagcggggcgtccgggaacatagtgagctctgtgaacacgattagcaaaatgctgctcaatcggttcaccacgcgccaccggaaaccgacctacgagaaggacgttgatctgggcgcgggtaccagatccgtgagcacagagacggaaaagccggacatgaccatcataggccggcggctgcaaagactccgcgaggagcacaaagagacgtggcactacgaccaggagaatccctaccgtacgtgggcgtaccacgggtcttacgaggcccccagcacgggctccgccagctccatggtaaacggcgtcgtgaagctgttaacgaagccgtgggacgtgattccaatggtcacccagctcgccatgacagacacgaccccgtttgggcaacagcgcgtcttcaaagagaaggtggacacgcggacgcctcagcccaagcccggcacgcgcatgattatgaccaccaccgcgaactggctgtgggcgctgctcggtaagaagaagtccccgcggttgtgcacgagagaggagttcatctcaaaggtgaggtctaacgccgctatcggcgcagttttccaggaagaacagggttggacgtccgccagcgaggccgtgaacgacagccgcttctgggagttagtcgacaaggagagagcgctgcatcaggaaggaaagtgcgagtcctgcgtgtacaacatgatgggcaagcgcgagaagaagctgggggagttcggccgcgcgaagggcagccgggcgatctggtacatgtggctcggcgccagattcctcgagtttgaggcactaggcttcttaaacgaagaccactggttctccagggagaatagctggagcggcgtggagggagaggggctccaccggctgggctatatccttgaggacatcgacaagaaggacggggatctaatctacgccgacgataccgcggggtgggacacgcgaataacggaggacgaccttctgaatgaggagcttatcactgagcagatggcaccccaccataaaaccctggcaaaggcaatcttcaagttaacctaccagaataaggtggtgaaggtgctccgccctacgcccaagggggctgttatggacatcatttcgcggaaggatcaacgcgggtccggccaggtgggcacctacggcctgaacacgttcaccaacatggaggtccaattaatccgacagatggaggccgagggggtcatcacccaagacgatatgcagaaccccaaggggctcaaagagcgtgtggaaaagtggctgaaagagtgcggcgtggaccgactgaagagaatggccatatcaggggacgactgcgtcgtgaagcccctcgatgaacggttctccacgagcctgctgttcctcaatgatatgggcaaggtgcgcaaggacatcccgcagtgggaaccctccaaggggtggaagaactggcaggaggtccccttttgttcccaccacttccacaagatcttcatgaaggacggccggtctctggtggtgccctgccgcaaccaggacgagctgatcgggcgagcccgcatctctcagggcgctgggtggtccctccgcgagaccgcgtgcctagggaaagcctatgcacaaatgtggtcgctgatgtacttccaccgccgcgatctgagattagcctccatggccatctgctcggcggtaccgactgagtggttccctacaagtcgcaccacctggagtatacacgcccaccatcaatggatgactaccgaggatatgctgaaggtgtggaaccgggtgtggatagaagacaaccctaacatgacggataagacccccgtccattcgtgggaggacataccgtatttaggcaagcgcgaggacctgtggtgcgggtccctgataggactcagctcgcgggccacctgggccaaaaatatccacaccgccatcacccaggttcggaatctgatcggaaaggaggaatacgttgactacatgccagcaatgaagcgttattcggcccccttcgagtccgagggcgtgctgtga

SEQ ID NO: 26298 - RNA, 9867 nt, synthetic construct
  misc_feature 1..9867: note = derived and/or modified CDS sequence (opt11) from DENV-4__JQ915088__SS-prME
  source 1..9867: mol_type = other RNA
tcgaccatgaccctgctctgcctgattcccactgtgatggccttccacttatctacccgggacggcgagccgcttatgatcgtggccaaacatgaacgagggaggcccctgcttttcaagaccaccgaaggcataaataagtgcaccctcatagctatggacctgggggagatgtgcgaggacaccgtgacatataagtgcccactactcgtaaacaccgagccggaggacatagactgctggtgcaacctgacgagcacctgggtcatgtatgggacctgcacgcagtccggggagcgccgtcgagagaagcgcagcgtggccctgactccccattcaggcatggggctcgagacacgggccgaaacctggatgagctccgagggggcttggaagcacgcccagagggtggagtcttggatcctgcggaaccccggcttcgcgctgctcgcggggttcatggcatatatgatcggccagaccgggatccagcgcatcgtgttcttcgtgctgatgatgctggtggccccctcctacggcatgcggtgcgtgggtgtgggcaaccgcgacttcgtggagggcgtcagcggaggcgcgtgggtggacctcgtgctggagcacggcgggtgcgttacgaccatggcacaggggaagcccaccctggacttcgagctcaccaagacgactgccaaggaagtggcactgctgcggacttactgtatcgaggcgtccatttcgaacatcaccacggctacccgctgtccgacccaaggggagccctacctcaaggaggagcaggaccaacagtacatctgccggcgcgacgtggtagacaggggctggggaaatggctgtggcctgttcgggaaggggggggtggtaacctgtgcaaagttcctgtgctctggcaagatcacggggaacttagtgcagatcgagaacctggagtacacggtggtggtcacggtgcacaacggcgacacgcacgccgtcggcaacgacacgagcaaccacggggtgaccgctaccatcacgccgcggtcccctagcgtggaggtcaagctgccggactatggcgagctgacgctggattgcgagccccggtcagggatcgactttaatgaaatgatcctcatgaaaatgaagaagaaaacctggctcgtgcacaagcagtggttcctggacctacccctcccctggaccgccggcgcggacacttctgaggtgcactggaactacaaggagcgcatggtaaccttcaaggtgccgcacgccaagcggcaggacgtgacggtcctggggtcccaggagggcgccatgcattctgccctggccggcgcgaccgaggtggattctggggatggcaaccacatgttcgcggggcacctcaagtgtaaggtgcgcatggagaagttgcggatcaagggcatgtcctacaccatgtgcagcggcaaattctccatcgataaggagatggccgaaacccagcacgggactaccgtcgtgaaggtgaagtacgagggcgccggggccccctgcaagatccccatagagatccgggacgtcaacaaggagaaggtggtgggccgcatcatcagctcgactccattcgcggagaacaccaactccgtcatcaacatagagctggagccgcctttcggagactcctacatcgtgatcggcgtgggcgacagcgccctaacgctgcattggtttcggaagggcagttccataggcaagatgttcgagtccacctaccgcggggcaaagcggatggccatcctgggcgagaccgcgtgggacttcgggagcgtcggcggcctcttcacctccctggggaaggccgtacaccaggtgttcggcagcgtctatactaccatgttcgggggcgtgtcctggatgatccgtattctgatcggtttcctcgtgctgtggattggcaccaacagccgtaacacttccatggccatgacgtgcatcgccgtcggcgggatcaccctgttcctgggctttacggtccaggcggacatggggtgcgtggtcagctggaacggcaaagagctcaagtgcgggtccgggatcttcgtggttgataacgtccacacttggacggagcaatacaagttccagcccgaaagccccgcgcgcctggccagcgccatactgaacgcccacaaggacggcgtatgtgggattcggtccactaccagactcgaaaacgtgatgtggaagcagatcaccaacgagctgaactacgtcctctgggagggagggcacgacctcacggtggtggccggggacgtgaagggcgtactgactaaagggaagcgggccctgaccccacccgtgaacgacctcaagtacagctggaagacatggggcaaggccaagatctccacgcccgaggctcgcaacagcactttcctaatcgacgggccagacacttccgagtgcccgaacgagcgtcgcgcctggaacttcttcgaagtcgaggactacgggttcgggatgttcaccacaaacatctggatgaagttccgggaggggagctcagaggtgtgcgaccaccgcctgatgagtgctgccatcaaggatcagaaggccgtgcacgctgacatgggctactggatcgagtccagcaagaaccagacgtggcagatcgaaaaggcctccttgatagaggtcaagacctgcctgtggcctaagacgcacacgctctggagcaacggggtgctcgagtctcagatgctgataccacggagctacgcaggcccgttctcccagcacaattaccgccaggggtacgccacgcagaccgccggcccttggcatcttggaaaactcgagatcgacttcggcgagtgtcccggcaccaccgtgaagatccaagaggattgcgaccaccgggggccgagtctgcgtacgaccactgcatccggcaagctggtcacccagtggtgctgtcgcagctgcacgatgccgcccctccggttcctgggggaggacggttgctggtacggcatggagatccgtcccctaagcgagaaagaggagaacatggtaaagtcccaggtgaccgcaggacagggcaccagcgagaccttctccatggggctcctgtgcctgaccctgtttgtggaggaatgcctccggcggcgagtgacacgaaagcacatgatcctggtcgtggtgatcacattctgcgcgatcatcctgggcgggctaacatggatggacctgctcagagccctgatcatgctgggcgacacgatgtccggccgcattgggggtcagatccacctcgccatcatgaccgttttcaaaatgtcccccgggtacgtgctaggcgttttccttcggaagctcactagccgcgagacggccctgatggtgataggaatggccatgacgaccgtgttctccatcccacacgacctgatggagctcatcgatggaatcagcctgggcctgatcttgctgaagatagtgacccacttcgacaacacccaggtggggacgctggcgctcagccttaccttcatgcggagcacaacgcccctggtgatggcctggcggacgatcatggccgtgttcttcgtcatcaccctgattcccctgtgtcggacctcctgcctgcaaaagcagagccactgggtggaaatcaccgcgttgatcctcggcgcgcaggcgttgcccgtatacctgatgacgctgatgaagggggcctcccgccggagctggcctctgaacgagggcatcatggccgtcgggctcgtgtcactgctcggcagcgccctgctgaagaacgacgtgcccctggcgggccccatggttgccggggggctcttgctcgccgcttacgtgatgtccgggagcagtgcggacctgagcctggagaaagcggccaacgtccagtgggacgaaatggccgatataaccggcagctcccccataatcgaagtcaagcaagacgaggacggaagcttttccatccgcgacgtggaggagaccaatatgattaccctgctcgttaagctggccctaatcacggtttcgggcctctacccgctggccataccggtcacaatggcgctgtggtacatctggcaggtaaagacacagcggtccggcgccctctgggacgtccccagccccgccgccacccagaaggccactctgtctgagggagtgtatcgcatcatgcagcggggcctgttcggtaagacccaggtgggcgtcggaatccacatggagggcgtgttccacaccatgtggcacgtgacccgcggcagcgtcatttgccacgagacaggtcggttggagccgtcctgggcggacgtgcgcaacgacatgatcagttacggcggaggctggaggctgggcgataagtgggataaggaggaggacgtgcaagtcctggccatcgagccagggaagaatccccggcacgtgcagacaaagcccggcctgttcaagaccctgacgggggaaatcggagccgtgacgctggactttaaaccggggacaagtggctcacctatcatcaataagaagggcaaggtcatcgggctctacgggaacggggtggtcaccaagtccggcgactatgtcagcgccatcacccaagccgagcgcattggggagcccgactacgaggtggatgaggacatcttccggaagaagagactaaccattatggaccttcatccgggcgcggggaagacgaagcggatcctcccctccatcgtgagagaagccttgaagcggcgcctgcggaccctcatcctagccccgacgcgagtcgtggccgcggagatggaagaggccctgcgggggctgcccatccgctaccagacccccgccgtgaagtccgaacacacgggccgggagatcgtcgacctcatgtgccacgccaccttcaccacacgcctgctgtcatcgacgcgtgtgcccaactacaacttgatcgtgatggacgaggctcacttcaccgacccctgctccgtcgcggcccgcgggtacatcagcaccagagtggagatgggcgaggccgctgccatcttcatgaccgccacgcccccggggagcatcgaccccttcccccagtccaacagcccgatcgaggacatcgagagggagatcccggaacggtcctggaacaccggcttcgactggatcaccgattaccagggcaagactgtctggttcgtgcccagcattaaggccgggaacgacatcgccaactgccttcgcaagtccggcaagcgggtgatacagctgtcgaggaagacattcgacaccgagtaccctaagacgaagctcaccgactgggactttgtcgtgacgaccgacatctccgagatgggggccaatttccgcgccggccgggtaatcgatccccgtcggtgcctgaagcccgtcattctgaccgacgggcccgaacgtgtgatcctcgcgggccccatccccgttacccccgctagcgccgcccagaggcggggcaggatcggacgcaacccagcgcaggaggacgaccaatatgtgttttccggcgaccccttgaagaacgacgaagaccacgcccactggacggaggccaagatgttgctcgacaacatttacacccccgaggggatcatcccgaccctgtttggccccgagcgggagaaaacccaggcaattgatggcgaattccgtctgaggggtgagcagcgcaagacgttcgtggagctcatgcggcgcggcgacctgcccgtgtggctgagctataaggtcgcatccgcggggatcagctataaggaccgggagtggtgcttcaccggagagcgcaataaccaaatcctcgaagagaacatggaggtcgagatttggacacgggagggggaaaagaagaaactgcgccccaaatggctggacgcccgcgtttacgccgacccgatggccctcaaggacttcaaggagttcgccagtggccgcaagagcaccacgctggacatccttacagagattgcgaccctccccacgtacctgtcctccaaggccaagttggctctcgacaacatcgtcatgctgcacactacggagaagggcggtcgggcgtaccagcacgccttaaacgagctgcccgagtcactggagacccttatgctcgtggcgctgctgggcgcgatgaccgccgggatcttcctcttcttcatgcagggcaaggggatcggaaagctgagcatgggactgattgcaatggcggtggcctccgggttgttatgggtcgctgagatccagcctcaatggattgccgcgagcatcattctggagttcttcctcatggtgctgctgatccccgagcccgagaaacagcggacgccccaggacaaccaactcatttacgtgattctgacgatactgaccataatcggcctcatcgcggccaacgagatggggctgatcgaaaagaccaagaccgacttcggcttctaccaggttaagacggaaaccaccatactcgacgtggacttgcgcccggcctctgcctggaccctctacgcggtggcgacgaccatactgacccccatgttacggcacacaattgagaacacgtccgcaaacctgagcctggccgccatcgccaaccaagcggccgttctcatggggctgggcaagggctggcccctgcacagaatggatctcggggtccccctgctggccatgggttgctattcgcaggtgaatccaactacactcacagccagcctggtcatgctgctcatccactatgcgatcatcgggcccggcctccaggcgaaggccacgcgggaggcccaaaagcgcaccgccgcgggcatcatgaaaaatcccaccgtagacgggatcaccgtcatcgacctcgagcccatatcctacgacccgaagttcgagaagcaactcggccaggtcatgctgctggtgctctgcgttgggcagcttttgctcatgcggacgacctgggccctttgcgaagtcctgaccctcgccaccggccccatcatgactctgtgggaggggaaccccggccgcttctggaacacaaccattgccgtaagcaccgccaacatcttccggggctcctacctggcgggggccggtctcgccttcagcttaatcaagaacgcccagacccccagacgggggaccggcacgacgggggagacgcttggcgagaagtggaagcgccagctcaactccctggaccgcaaggagttcgaggagtacaagcgcagcggcattctggaggtggaccggactgaggctaagtccgcgctccgcgacgggagtaagatcaagcacgccgtctcccgcggtagctccaagatccgctggattgtggagcgtgggatgattaagccgaagggtaaggtggtcgacttaggctgtggccgcggggggtggagctactacatggccaccttaaaaaacgtaactgaggttaagggctacaccaaggggggcccagggcacgaggagcccatccccatggccacgtacgggtggaacctcgtaaagctacactccggcgtggacgtcttctacaagccgacggagcaggtagacaccctgctctgtgacatcggggaaagctccagcaaccccacgatcgaggagggcaggacgctgcggatactgaagatggtggagccatggctcagctccaagcccgaattctgtatcaaggtcttgaacccatacatgccgaccgtcatcgaggagctggagaaactccagcgccggcacggagggagcctggtgcgctgccccctgagccggaacagcacccacgagatgtactgggtctccggcgccagcgggaacatcgtctccagcgtgaacaccatctccaagatgctgctcaaccgcttcacgacccggcaccgcaagcccacctacgagaaggacgtcgacctgggcgcgggcactcggagcgtgtccacggagaccgagaagcctgacatgacaatcatcggccgccggctgcagcgcctgcaggaggagcacaaggagacatggcactacgaccaggagaacccctaccggacgtgggcctaccacgggagctacgaagcaccctctaccggtagcgcctccagcatggtgaacggggttgtgaagctgttgactaagccgtgggacgtgatccccatggtcacccagctcgcgatgacggatacgacccccttcgggcagcagcgcgtgttcaaggagaaggtagacactaggacgccccagccgaaactcggcacgcgcatgataatgacgaccacggccaactggctgtgggccctactggggaagaaaaaatcaccgcggctctgcacgcgcgaggaattcatctccaaggtgcgtagcaacgccgccatcggagcggtgttccaggaggagcaggggtggacctctgccagcgaggcagtgaacgattcacgcttctgggagctcgtcgacaaggaacgggccctgcaccaagagggcaagtgcgagagctgtgtgtacaacatgatgggtaagagggagaagaagctgggggagttcggccgcgccaaggggtcccgggcgatctggtacatgtggctcggcgctcgatttctggagttcgaggccctggggttcctcaacgaggaccactggttctcgcgggagaactcctggagcggcgtggagggcgaggggctgcatcgcctcggatacatcctcgaagacatcgacaaaaaggatggggatctgatctatgcggacgacaccgcgggctgggacacgcggatcaccgaggacgacctgctcaacgaagagttaattaccgagcagatggcgccccaccataagaccctggccaaagcgatctttaagctcacctatcagaacaaagttgtgaaggtgctacgtcccacacccaaaggcgcggtcatggatattatctccaggaaggaccagcgcgggagtggccaggtggggacatacggcctgaacaccttcactaatatggaggtccagctcatccgccagatggaggcggaaggcgtcattacgcaggacgacatgcagaaccccaagggcctgaaggaacgcgtggagaagtggctgaaggagtgcggtgtggacagactcaagcgcatggccatctccggggacgactgcgtcgtgaagccccttgatgagcggttcagcacctccctcctcttcctgaacgacatggggaaggtgcgcaaggacgtcccccagtgggagcccagcaaggggtggaagaactggcaggaggttcccttctgctcacaccacttccacaagatattcatgaaggacggccggagcctggtggttccctgtcgcaatcaggacgagctcatagggagagcccgcatctcccagggcgccggctggagcctgcgcgagaccgcctgcctggggaaggcgtacgcccagatgtggtctctcatgtacttccaccgccgcgacctgcggctggccagtatggccatctgcagcgccgtgcccacggagtggttcccgacgagtcgcaccacctggagcatccacgcgcagcaccagtggatgaccacggaagacatgctgaaggtgtggaaccgggtctggatcgaggacaaccccaacatgaccgacaagacccccgtgcactcctgggaggacatcccctatttaggcaagcgtgaggacctgtggtgtgggtcactcatcggcttatccagccgggccacctgggccaagaacatccacacggcgatcacgcaggtccgtaatctgattggtaaggaggagtacgtcgactacatgcccgtgatgaaacggtactccagcccctccgagagcgagggcgtgctctga

SEQ ID NO: 26299 - RNA, 9867 nt, synthetic construct
  misc_feature 1..9867: note = derived and/or modified CDS sequence (opt11) from DENV-4__JQ915086__SS-prME
  source 1..9867: mol_type = other RNA
agcaccatgaccctgctgtgcctgatccccaccgtgatggccttccatctgagcacccgcgacggtgagccgctcatgatcgtggccaagcacgagcgggggcgacccctgctgttcaagaccaccgaggggatcaacaagtgtacgcttatcgcgatggacctgggggagatgtgtgaggacaccgtaacctacaagtgccccctgctcgtcaacaccgaacccgaagacatcgattgctggtgcaaccttacatcaacctgggtgatgtacgggacctgcacgcagtccggggaacggcgccgcgagaagcgcagcgtggcacttactccgcactccggcatgggcctcgagacccgggcagagacttggatgagctccgagggggcatggaagcacgcccagagggtggaatcttggatcttacggaacccgggcttcgcactgttagctgggttcatggcctacatgatcgggcaaaccgggatccagcgcaccgtcttctttgtgctgatgatgctggtggctcccagttacggcatgagatgcgtgggagtggggaaccgcgacttcgtcgagggggtcagcggaggggcgtgggtggacctcgtgttagagcacggaggttgtgtaacgaccatggctcagggcaagcccaccctggacttcgaactgacgaagacaaccgccaaggaggtggcccttctacggacctactgtatcgaggcatctatcagcaacattacgaccgcaacccgctgcccgacgcagggggagccctacctcaaggaggagcaggaccagcagtacatctgccgacgcgacgtggtcgatcggggctgggggaacggctgcgggctgttcggcaagggcggagtggtgacgtgcgccaagttcctgtgctcgggaaagatcaccgggaacttagtccagattgaaaacctggagtacaccgtggtggtgaccgtccataacggagacacacacgcggtcggcaacgacactagcaaccacggggtgaccgccacaataacgccgcgctcccccagcgtagaggttaagctgccggactatggcgagctcaccctggattgcgagccccggtcggggatcgacttcaatgagatgatccttatgaagatgaagaagaagacctggctcgtacacaagcagtggttcttagatctgccactcccctggaccgccggtgctgacactagcgaggtgcattggaactacaaggagagaatggtcacgttcaaggttccgcacgccaagcgacaggatgtgacagtcctgggatcccaagagggcgctatgcacagcgccctggccggtgcgaccgaagtggacagtggggatggcaaccacatgttcgccgggcacctcaaatgcaaggtgcgcatggagaagctgagaatcaaaggcatgtcctacacaatgtgcagcggtaagttcagtatcgacaaggaaatggctgagacacagcacggtaccaccgtcgtgaaagtaaagtacgagggcgccggggctccctgcaagattcccatcgagatccgggacgtcaacaaggaaaaggtggtgggcaggatcatcagttccacacccttcgcggagaacactaatagtgtcatcaacatcgaactagaaccgccattcggtgactcgtacatcgtgataggcgttggtgacagcgctctaaccctgcactggttccggaagggctccagcatagggaagatgttcgagagcacctaccgcggggccaagcggatggccatcctgggcgagaccgcgtgggactttggcagcgtcgggggcctcttcacgtcactggggaaggcagtgcaccaggtcttcggcagtgtatacaccaccatgttcgggggcgtgtcctggatgatcagaatcctgatcgggtttctcgtgctgtggatcggcaccaattctcgtaacacttccatggctatgacatgtatcgctgtcggcggcatcactctgttcctgggatttacggtgcaagctgacatgggttgcgtggtgagctggaacggaaaggagttgaagtgcgggtccggcattttcgttgtggacaacgtccacacgtggacagagcagtacaagttccagcccgagagccccgcgcgcctggcgtcggcaatcctgaacgcacacaaggatggcgtctgtgggatccggtccaccacccgcctcgagaacgtgatgtggaaacagattacaaacgagctgaactacgtcttgtgggagggcgggcatgatctcaccgtggtggctggcgacgtaaagggcgtgcttaccaaggggaagagggtgctcaccccgcccgtcaacgatctcaagtacagctggaagacgtggggcaaggcgaagatcttcacacccgaggcccgcaattctaccttcctgatcgacgggcccgacacgagcgagtgccccaacgagcggcgagcatggaacttcttcgaggttgaggattatggcttcgggatgttcacgacgaacatctggatgaagttccgggagggctccagcgaggtctgtgaccaccgcctgatgtccgcagcaataaaagatcaaaaggccgtgcacgctgacatgggttactggatcgagagctcaaagaaccagacgtggcagatagagaaggcctcgctcatagaggttaaaacgtgtttgtggcccaagacacacaccctgtggtccaacggggtgctcgaatctcagatgctgatccccaggtcctacgcaggtccgtttagccaacataactaccggcaggggtacgccacccaaactgccggcccctggcacctggggaagctcgaaattgactttggtgaatgccccggaaccacggtcaagatacaggaagactgcgaccaccgggggccctccctgcgcaccaccaccgccagtggcaagctcgttacgcagtggtgctgccgctcttgcaccatgccacccctccgcttcctgggcgaggacggctgctggtacggcatggagatccgccccctgagcgaaaaggaggagaacatggtcaagagccaggtcaccgcgggccagggcacctccgagacgttcagcatgggtctgctgtgcctgacccttttcgttgaggagtgtctgcggagacgggtcaccaggaagcacatgatcttagtggttgtaatcaccttctgcgccatcatcctcggcgggctgacgtggatggacctgctccgggcgctgatcatgctgggggataccatgtccggccgcatcgggggccagatccacctcgccatcatgaccgtgttcaaaatgtcacctggctacgtgctaggcgtcttcctgcggaagttaacctcccgcgaaacggccttgatggttatagggatggcgatgacaacggtgttcagcatcccgcacgacctgatggaactcatcgatggcatctccctggggctcatcctcttgaagatagtcacccactttgacaacacccaggtggggaccttagccctctctctgaccttcatccggtcaaccacgccgctggtgatggcgtggcgaactattatggccgtcttctttgtaatcactctaatccctctgtgtaggacctcatgcctccagaagcagtctcactgggtagagattacagccctcatcctgggcgcccaggctctgcccgtgtacctcatgaccctgatgaagggggcgagcagacggtcctggccgctgaacgagggcatcatggccgtggggctcgtgagcttactgggcagtgccttgctgaagaacgacgtacccctggcagggcccatggtggccgggggactcttgctggccgcttacgtgatgagcgggtcctccgcagacctatcgctggaaaaggcagcgaacgtccagtgggacgagatggccgacatcactggatctagtcccatcatcgaggtgaaacaggacgaggacgggagtttcagcatacgcgacgtggaagagaccaacatgatcaccctgctcgtaaagctggcactgattaccgtgtctggcctctacccgctggcgattcccgtgaccatggcactgtggtacatctggcaggtcaagacccaacgcagcggcgcgctctgggatgtaccctcccctgccgccacgcagaaggccaccctgagcgagggggtgtaccgcatcatgcagaggggcctgttcgggaagacccaggtcggtgtggggatccacatggaaggcgtgttccacaccatgtggcacgtcacccgcggctccgttatctgccacgagacggggaggctcgagccgtcatgggccgacgtccgcaacgacatgatatcatacggcgggggctggcgcctgggagacaagtgggacaaggaagaggacgtccaggttctggcgatcgagcccgggaaaaacccccggcacgtgcagacaaagcccggcctatttaagaccctgaccggggagataggcgccgtcacactggactttaaaccggggaccagtggctccccgatcatcaacaagaagggcaaggtgatcgggctatacggcaacggggtcgtcacgaaaagcggcgactacgtcagtgccataacacaggccgagcgcatcggcgagcccgactatgaagtcgatgaggacatcttccggaagaagcgcctcacgatcatggacctgcacccaggggccggcaagaccaagcgcatcctccctagcatcgtccgcgaggcgctgaagcggcgcctgcgaaccctcatcctagcccccaccagagtggtggccgcagagatggaggaggctctgagggggctgccaatccgttaccagacgccggccgtaaagtccgagcacaccggtcgggagatcgttgacctcatgtgccacgccaccttcaccacgcgcctgctgagctccacccgcgtgcccaactacaatctgatcgtcatggacgaagcccatttcaccgatccctgcagtgtcgccgcgcgagggtatatctccacccgggtagagatgggcgaggccgccgccatctttatgacggccacgcccccagggtccatagaccccttcccccagagcaacagtcccatcgaggacattgaaagagagatcccggagcggagctggaacaccggcttcgactggatcaccgattaccaaggcaagactgtgtggttcgtgccgagcatcaaggcggggaatgacatagcgaactgcctgcgcaagagcggcaagcgagtcatccagctgagtcggaaaacattcgacaccgaatatcccaagaccaaactcacggactgggatttcgtggtgaccaccgacatcagcgaaatgggggccaacttccgcgcaggcagagtcatcgatcccaggagatgcttgaagcctgtgatcctgaccgacgggcccgaacgagtgattcttgccggccccattcctgtcacgccggcttcggccgctcagaggcgcggccggatcggccgcaaccccgcacaggaagacgatcaatacgttttcagcggggaccccctgaagaatgacgaggaccacgcccattggaccgaggccaagatgcttctcgacaacatctacacccccgaggggatcatcccgactctgttcggcccagagcgggagaagacccaggcaatcgacggcgagtttcgtcttcgcggggagcagcggaaaaccttcgtggagctcatgcggcgcggcgacctccccgtctggctgtcctacaaggtggccagcgccgggatctcctacaaggaccgagagtggtgcttcaccggcgagcgaaacaaccaaatcctcgaagagaacatggaggtggaaatctggactcgggagggggagaagaagaaacttcgccccaaatggttagacgcgagggtatatgccgaccccatggccctcaaggacttcaaggagtttgccagcggccgcaagtccacgaccctggacatcctgaccgagattgccaccctccccacctacctcagctccaaggccaaattagcactcgacaacatcgttatgctgcacaccaccgagaaagggggtcgcgcctaccagcacgcacttaacgagctccccgagagcctagagaccctgatgctggtggccctgctaggtgcgatgaccgccggcatattcctcttctttatgcagggcaagggcatcggtaaactttccatgggcctgatcgccatcgccgtcgcgagcgggctcctgtgggtggcagaaatccaaccgcagtggatcgccgcttccatcattctggagttctttctcatggtgctgttaataccagaacccgagaaacagcgcacgccccaggacaaccaactcatctacgtgatcctgacgattctcaccataatcggcctaatcgccgcgaacgagatgggactgatcgagaaaactaagacggacttcggcttttaccaggtgaagaccgagaccaccatcctcgacgtagatctgcgcccggcaagcgcctggacgctgtacgccgtcgcgaccaccatcctcaccccaatgctccggcacactatcgagaacaccagcgccaatctttccctcgccgctatcgccaaccaggccgcggtactcatgggcctggggaagggctggcccctgcaccggatggacctcggggtccccctcctagccatgggctgctacagccaggtcaaccccacgactctcacggcttccctagtgatgctgctcattcactacgccatcatcgggcccggactgcaagctaaggcgactcgtgaagcacagaaacgcactgccgccggcataatgaagaaccccaccgtggatgggatcactgtcatcgatctggagcccatctcctacgatccgaagttcgagaaacagctcggccaggtaatgctgctggttctctgcgtcgggcagttgctgcttatgagaaccacgtgggcactgtgtgaagtgcttaccctcgccacgggccccatcatgaccctttgggaggggaatcccggccgcttctggaacacaaccatcgccgtatccacggccaacattttccggggcagctacctggcgggtgctggcttagccttctccctaatcaagaacgcgcaaacgccccggagaggcacaggcaccactggggagaccctgggcgagaagtggaagcggcagttaaacagcctggaccggaaggagtttgaggaatataaacgctccggcatcctggaggtcgaccggaccgaggcaaagagcgccctccgagacgggtccaagattaagcacgcggttagccggggatctagcaagattcgctggatcgtcgagcgggggatgatcaaacctaagggcaaggtggtggacctggggtgtggccggggcgggtggtcttactacatggcaactctgaaaaacgtgacggaggtcaagggctacacgaagggcggcccagggcacgaggagccgattccgatggcgacctacggctggaacctcgtgaagttacatagcggcgtggacgtgttctacaagccgaccgagcaggtcgataccctgctgtgcgacatcggggaatccagttccaacccaacgatcgaggagggcagaactctgcgaatactgaaaatggtggagccttggctcagcagcaagccagagttttgtatcaaggttctgaatccgtacatgcccacggtgatcgaagaactggagaaacttcaacggcgccacggtggctcactggtacgctgccccctttcacggaacagtacccacgagatgtactgggtcagcggggcgtccggtaacatcgtgagctcggtaaacacgatcagcaagatgctgctcaacaggttcactacccggcaccgcaagccaacttacgagaaggatgtagacctgggggccgggacaagatccgtgagcaccgagaccgagaagcccgacatgaccatcatcggacgccgcctgcagcgtttgcaggaggagcataaggagacgtggcactacgaccaggaaaacccctatcggacttgggcgtatcacgggtcatatgaggcccccagcaccggctccgccagctccatggtcaacggcgtagtgaagctgcttacaaagccgtgggacgtcatccctatggtgacgcagctcgccatgactgacaccacccccttcgggcagcagcgcgtgttcaaggagaaggtcgacacgaggacgccccaaccgaaactggggacccgcatgatcatgaccacgaccgcgaactggctgtgggcactcttggggaagaagaagtcccctcggctgtgcactcgcgaggagttcatcagcaaagtgcgcagtaacgccgccattggcgccgtgttccaggaggagcaggggtggaccagcgcgagcgaggccgtcaacgacagccgcttctgggagctcgtggacaaggagagggccctgcaccaggagggcaagtgcgagtcctgtgtgtataacatgatgggcaagcgcgagaagaagctgggggaatttggccgcgccaaggggagccgggccatatggtacatgtggctaggcgcgcgcttcctggagttcgaggccctaggcttcctcaacgaggaccattggttctcccgggaaaattcctggtccggcgtggaaggcgaggggctgcaccgcctgggctatatactcgaggatatcgacaagaaggacggggacctgatctacgcagacgatacggccggctgggacacccgcatcaccgaggacgacctactcaacgaggaactgatcaccgagcagatggctccccatcataagacgcttgcgaaggccatctttaagctcacctaccagaacaaggtggtgaaggtcctgcgccccacccccaagggcgccgtgatggatatcatcagcaggaaggatcagcgggggtccggccaggtggggacctacggcttaaataccttcacgaacatggaagtccagctcatccggcagatggaagccgagggggtgataacccaggatgatatgcaaaaccctaagggccttaaggagcgagtggagaagtggctgaaagagtgcggtgtagacagactaaagaggatggcgattagtggggacgactgcgtggtgaagcccttggacgagcggttttcaacctccctcctgttcctgaatgacatgggcaaggtgcgcaaggacgtcccacagtgggagccgtccaaggggtggaagaactggcaagaggtacccttttgtagccaccattttcataaaatattcatgaaagacggccggagcttagtcgtgccctgccgcaaccaggacgagctcatcgggcgggcccgtatcagccaaggcgccggctggtccctgcgggaaacagcctgcctggggaaggcatacgcccagatgtggtccttaatgtacttccaccggcgcgacttaaggctggccagcatggccatctgttccgccgtgcccacggagtggtttccgacaagcaggaccacctggtccatccacgcccaacatcagtggatgactacggaggatatgcttaaggtctggaaccgagtgtggatcgaggataatcccaatatgacggacaaaacccccgtgcacagctgggaggatatcccctatcttggcaagcgcgaggacctgtggtgcggcagcctcataggcctgagctcccgggcgacgtgggccaaaaacatccataccgccatcacgcaggtccgcaacctgatcgggaaagaagagtacgtggactacatgccggtgatgaagcggtactcagccccctccgagagcgagggcgtcctctga

SEQ ID NO: 26300 - RNA, 9867 nt, synthetic construct
  misc_feature 1..9867: note = derived and/or modified CDS sequence (opt11) from DENV-4__JQ915087__SS-prME
  source 1..9867: mol_type = other RNA
tcgaccatgaccctgctctgcctaataccaactgtgatggctttccacctatcaacccgcgatggcgagccgttaatgatcgtggcgaaacacgagaggggacgccccctgctgtttaagacgactgagggcatcaacaagtgtacactaatagcgatggatttgggggaaatgtgcgaggacaccgtaacgtacaaatgccccctgctagtgaacaccgagccagaggacatcgattgctggtgtaacctgacgtcgacctgggtgatgtacggtacctgcacccaatccggggaacggcgccgggagaagcggagcgttgccctcacgccgcacagcggcatgggcctagaaacccgcgccgagacctggatgagcagcgaaggggcatggaagcacgcacagagggtggagagctggatattacgtaatcccggcttcgcgcttctcgccgggtttatggcgtacatgattggtcagaccggcattcagcgcatcgtctttttcgtgctgatgatgctggtcgccccctcatacggcatgcggtgcgtcggcgtggggaaccgcgatttcgtggagggcgtcagcgggggcgcgtgggtggacctagtgctggagcacggtggttgcgtaacgaccatggcccaagggaagcccacccttgacttcgagctcaccaagacaacagcaaaggaggttgctctgttacggacctactgtatcgaggccagcatcagcaacatcaccacggccacgcgctgcccgacccaaggcgaaccatacctcaaggaggagcaggaccagcagtacatctgccggcgcgacgtggtcgatcggggctgggggaacggatgcggtctcttcgggaagggcggggtggtcacctgtgcgaagttcttatgctcgggcaagataacggggaatttagtacagatagagaacctggaatacaccgtggtggtgactgtgcacaatggcgacacccacgcagtcggcaacgacacgtcgaatcacggggtgaccgccacgatcacgccccgttccccctccgtggaggtgaagctgcccgactacggagagctcactctggactgtgagccccgatccgggatcgactttaatgaaatgatcctgatgaaaatgaaaaagaagacatggctagtgcacaaacaatggttcttggacctgcctttaccctggaccgccggcgcggacactagcgaagtgcattggaactacaaggaacgaatggtcacgttcaaggtgccgcacgccaagcggcaggacgtgacggtcctggggtcgcaggagggcgcgatgcatagcgcccttgcgggcgcgaccgaggtagacagcggcgacgggaaccacatgttcgccgggcaccttaagtgcaaggtgcgcatggaaaagctgcggataaagggaatgtcctataccatgtgcagcggcaagttctccattgacaaggagatggcagagacccagcacgggacaaccgtcgtcaaagtgaagtatgagggggcaggcgccccttgcaaaattcccatagagatccgagacgtcaacaaggagaaagtggtcggcagaattatcagctcgaccccctttgcggagaacacaaacagcgtcatcaacatcgagctcgagccgccattcggggactcatacatcgtgataggcgtgggcgacagcgccctcacgctgcactggttccggaaaggttccagcatcggcaagatgttcgagtccacgtacaggggggccaagcgtatggctatcctgggcgagacagcgtgggacttcgggagcgtcggcggtctcttcaccagcctggggaaagccgtgcatcaggttttcggctctgtctacacgaccatgttcgggggcgtgtcctggatgatacgtatactgatcgggttccttgtgctttggatcgggaccaactcacggaacaccagcatggccatgacgtgcatcgccgtaggaggaatcacattatttctaggcttcaccgtgcaggcggacatgggctgtgtggtcagctggaatggcaaggagctcaaatgcgggtcaggcatcttcgtggtggacaacgttcacacctggacggagcagtacaaatttcagcccgagagccccgcgcgcctggccagcgccatccttaacgcccacaaggatggcgtatgcgggatccggtccaccacccgcttggagaatgtcatgtggaaacagattaccaacgagctgaattacgtcctgtgggagggagggcacgacctcacggtggtggccggcgacgtcaaaggcgtgctgaccaaagggaaacgggcgttaactccgcccgtgaacgacctcaagtacagctggaaaacctggggtaaggcgaagatctttacgcctgaggcgcgcaacagtacctttctgatcgacgggccagacaccagtgagtgtccgaacgaacggcgcgcctggaatttcttcgaagtcgaggactatggcttcgggatgttcaccacgaacatttggatgaagttccgggaaggcagtagcgaggtttgcgatcaccgcctgatgtccgccgcgatcaaggaccagaaggccgtgcacgctgacatggggtactggatcgaatcttctaagaaccagacatggcagattgagaaagcctcgctcatcgaggtcaagacgtgcctgtggcccaagacccatacgctctggtcgaacggggtgctcgagagccagatgctaatcccacggtcctacgctggccctttcagccagcacaactatcgccaggggtatgccacccagaccgccgggccctggcaccttgggaagctcgagattgacttcggggagtgccccggcaccaccgtgaagatccaggaggactgcgaccaccggggcccctccttacgcacgaccacggcgagcggcaagttagtcacccagtggtgctgccgttcgtgcacgatgccgccactacgattcctgggcgaggatggctgctggtatgggatggagatccgaccgctgagcgagaaagaagagaatatggttaaaagccaggtgactgcgggccagggaacctcagagaccttcagcatgggcctcctgtgcttaaccctcttcgtcgaagagtgcctcaggagacgggtgacccgcaagcacatgatcttagtagtggtgataaccttctgcgcgatcattctaggcgggttaacctggatggacctgctccgcgccctgatcatgctgggcgacactatgtccggtcgcataggaggacaaatacacctcgccatcatgaccgtgttcaagatgagccccgggtacgttctaggcgtcttccttcgcaagctcacctcgcgcgagactgccctgatggtcatcggcatggccatgaccaccgtgtttagcatcccgcacgacctaatggagctcatcgatggcatctcattgggactgatcctcttgaagatcgtgacccacttcgataacacccaggtggggacgctggcgctttcgctgaccttcatccggtcaaccactccccttgtgatggcctggcgtacgatcatggccgtatttttcgtcatcacactcatccccctatgtaggacgagctgcttacaaaagcagtcgcactgggtggagatcacggccctcattctgggcgcccaggcgctgccagtgtacctcatgacgctgatgaagggggccagccggcggtcctggccgctgaacgagggcatcatggccgtcggactcgtcagcctgctgggctccgccctcctaaagaacgacgtgcccctggcgggccccatggtcgccgggggtttactgctggccgcgtacgtgatgagcgggtcctcggccgacctctccctggaaaaggctgctaatgtgcagtgggatgagatggcagacatcactggcagcagcccgatcattgaggtcaagcaggacgaggatgggtcctttagcatacgcgacgtggaagagactaatatgataactctgttagtgaagttagccctgataaccgttagtggcctctaccctcttgccatccccgtgactatggcgttgtggtacatatggcaggtcaagacccaacggagcggcgcactctgggacgtcccgtcgccggccgccacccagaaggccacgctgagcgagggggtgtatcgcattatgcagcgcggcctgttcggaaagacccaggtgggggtcgggatccacatggaaggcgtgtttcacaccatgtggcatgttacccgcggctccgtcatctgccacgagaccggcaggctggagccgagctgggcggatgttcgcaacgatatgatatcgtatggcggcggctggcgcctgggtgataaatgggacaaggaggaagacgtgcaagtcctggccatcgagcctgggaagaacccccggcacgttcagacgaagccaggccttttcaagaccttaaccggggagatcggcgcggtaacactagatttcaagccggggacgagtggctcccccataatcaacaaaaagggcaaggttatcgggctctacggcaacggagtggtcaccaagtcgggcgactacgtctctgcgatcacccaggccgagcgaatcggtgaacccgattacgaggtcgatgaggacatctttcggaagaaacgcctgacaataatggacctgcacccgggcgcgggcaagacgaagcggatcctcccgagcatcgtgcgcgaagccctgaaaagacgcttacgcaccctcatactggcccccaccagagtcgtggcagctgagatggaggaggccttacgtgggctgcccatccgctaccagacccccgccgtcaagtctgagcatacgggccgggagatcgtcgacctaatgtgccatgccaccttcactaccagactgctgagctccacgcgggtgcccaattacaacttgatcgtgatggacgaggcccacttcacagacccctgcagcgtagcggcccgcgggtacatctctactcgtgtggagatgggcgaagccgcagccatcttcatgaccgccactcccccgggatctatcgacccattccctcagagcaactcccctatcgaagacattgagcgcgagattccggagagaagctggaacaccggcttcgattggatcaccgactaccagggcaagacagtctggttcgtgccctccatcaaggcggggaacgacattgccaactgcctgcgcaagagtggaaagcgcgtaatccagctcagtcggaagactttcgacaccgagtaccccaaaaccaagctcaccgactgggactttgtcgttacgactgatatctctgagatgggggcgaacttccgcgcgggtcgggtgatcgacccccgacggtgtctcaagccagtaatcttgaccgacgggcccgagcgcgtgatcctcgcgggccccatccctgtgaccccagcctccgccgctcagcggcgcggcagaatcgggcgtaaccccgcgcaggaggacgatcaatacgtttttagcggcgaccccctcaaaaatgacgaagaccacgcccactggacagaggccaagatgctgctcgacaacatttacacacccgaggggatcattccaaccctcttcggcccggaacgggagaagacccaggccatagacggcgagttccgactgcgcggggagcagcgtaaaacgttcgtggagctcatgaggaggggcgacctccccgtttggttatcgtacaaggtcgccagcgcggggatttcctataaggaccgggagtggtgcttcactggcgagcgcaacaaccagatactcgaggaaaatatggaagtggaaatttggacccgggagggggagaagaagaagctgcgacccaagtggctggacgcccgggtgtacgcggatccgatggccttaaaggacttcaaggagttcgccagcgggcgaaaaagcaccacattggacatcttgactgagatcgcgaccctgcccacctacctgagctcgaaggccaagctggccctcgacaacatcgtcatgctacacacgactgagaaaggcgggcgtgcttaccaacacgcgctgaacgaactgcccgaatcgctcgagacgctgatgctcgtggcgctgctgggcgcgatgaccgccggaatctttctcttcttcatgcagggcaagggaattggtaagctctccatgggtctgatcgcaatcgcggtggcttcagggctgctttgggtcgccgagatccaaccgcaatggatcgccgcctcgatcatcctggagttcttcctcatggtgctgcttatccccgagcccgagaagcagcgtacgccacaagataaccagttgatctacgtgatcttgaccatattgaccatcataggccttatcgccgcgaatgagatggggctcatcgagaagacgaagacggacttcggattctatcaggttaagacggaaaccaccatcttggacgtggatctccgcccggcttcggcctggaccctgtatgccgtggcgacgaccatcctgacccccatgctccggcacaccatcgagaacacgagcgccaacctttctctggccgccatcgctaaccaggccgctgtactcatgggactcggtaagggctggccgctgcatcgcatggacctcggggtgcctctgctggcaatgggctgttactcacaggtaaacccgacgaccctcaccgcttccctggtcatgctgctcattcactatgctattatcggacctggtctgcaggcgaaggccacacgggaggcccagaagcgcaccgcagctgggatcatgaagaaccccaccgtagacggaattaccgtaatcgatttggagcccatttcctacgatccgaagttcgaaaagcagctgggccaggtgatgctgttagtgctctgtgtggggcagctgctgctcatgagaacgacctgggctctgtgcgaggtgctgacccttgccaccggacccatcatgacgctgtgggaagggaaccccggccgcttctggaataccaccatcgcggtgtccaccgccaacatctttcggggcagctacctcgcaggggcaggactcgcattctccctgatcaagaacgcccagacgcccaggcggggtaccggcaccaccggggagaccctaggtgaaaagtggaagaggcaactcaacagcttagaccggaaggaatttgaggagtacaaacgctcgggcatcctggaggtggaccggaccgaggccaagtcagcgctccgcgacggatccaaaatcaagcacgccgtgagccggggcagttccaaaatccgctggatcgtggagcgggggatgataaaaccaaagggcaaagtggtcgaccttgggtgtggccgcggcggatggtcctattacatggctaccctgaagaacgtgacggaggtgaagggttacactaagggcggacccggccacgaggagcccatccccatggctacgtatgggtggaaccttgtcaagctgcacagcggcgttgacgtgttctacaagccgactgaacaggtcgatactctgttatgcgacatcggcgagtccagctccaaccccaccatcgaggagggccgtacgctgcggatcctgaagatggtggaaccgtggctctcgagtaagccggagttttgtatcaaagtgctgaatccttatatgcccaccgtcatcgaagaactggaaaagttgcagcgccgtcatgggggctccctggtgcgctgccccctgagccgaaactccacccacgagatgtattgggtgtcgggcgcctccggaaacatagtctcctccgtgaatacaattagcaagatgctgctcaaccgcttcaccactcggcacaggaagcccacctacgagaaggatgtcgacctaggcgcgggcacccgcagtgtttctacggaaaccgaaaagccagacatgaccatcataggccgccgactgcagcgactccaggaggaacacaaggagacttggcattacgaccaggaaaacccctataggacgtgggcgtaccacggatcctatgaggccccgtccacaggctccgccagctccatggtgaacggtgtcgtgaaactgcttacaaagccgtgggatgtgatacccatggtcacccagctcgcgatgacggataccacaccgttcgggcagcagcgcgtattcaaggagaaggtggacacccggacgccacagccgaagctgggcactcgcatgatcatgaccaccacggccaattggttatgggcactcctggggaagaagaagtcgccgagactgtgtacccgcgaggagtttatctccaaggtccggagcaacgcagccatcggcgctgtgttccaggaggagcaggggtggacctcggcatcagaggccgtgaacgacagccgcttctgggaactcgtcgacaaggagcgtgccctgcaccaagaggggaagtgcgagtcctgcgtgtacaacatgatggggaagcgcgagaagaagctgggggaattcggcagagccaaggggagccgggcgatctggtatatgtggctaggcgctagattcctggagttcgaggccctggggttcctcaacgaggaccattggttctcccgggagaatagctggtcgggcgttgaaggcgaggggctgcacagcctgggctacatcctcgaagacatcgacaagaaggacggcgaccttatctacgccgacgacaccgccggatgggacacgcgtatcaccgaggacgacctgttgaatgaagagcttatcacagagcagatggcgccgcatcacaagacactggccaaggccatctttaaattaacgtaccaaaacaaagtcgtgaaggtgctgcggccgacccccaagggcgccgtcatggacatcatctcccgcaaggaccagcggggcagcggccaggtggggacgtacggcctcaacaccttcaccaacatggaggtgcagttgatacgccagatggaggcggaaggggtcatcacgcaggacgacatgcagaaccccaagggcttaaaagagagagtggagaaatggctcaaggaatgcggcgtggaccgcttaaagaggatggcaatctccggggacgattgcgtagtaaagcccttggacgagagattcagcacctccctcctgttcctgaacgacatgggcaaagtccggaaggatgtcccccagtgggaaccatcaaaggggtggaagaattggcaggaggttcccttttgtagccatcacttccacaagatattcatgaaggatggacgctcgctggtggtgccctgtcggaaccaggacgagttaattgggcgtgccagaatatcccaaggggccggctggtcactgcgcgagacagcctgccttgggaaggcgtacgcacagatgtggtcgctgatgtatttccaccggcgcgatctccgccttgcttcaatggccatttgtagcgcagtgccgactgagtggttcccgacatcgcggaccacatggagcatacacgcgcagcatcagtggatgaccacggaggacatgctcaaggtgtggaaccgcgtctggatagaggacaaccccaacatgaccgacaagacccccgtgcattcttgggaggatatcccctatctgggtaaacgggaggacctgtggtgtggttcactcatcggcctgtcctcgcgcgccacctgggccaagaatatccataccgccatcacacaggttcggaacctaatcgggaaggaggaatacgtggactacatgccggtgatgaaaaggtactccgcccccagcgagtctgagggagtgctctga

SEQ ID NO: 26301 - RNA, 9867 nt, synthetic construct
  misc_feature 1..9867: note = derived and/or modified CDS sequence (opt11) from DENV-4__JQ915089__SS-prME
  source 1..9867: mol_type = other RNA
tcgaccatgacgctgctatgcctaatccccaccgtaatggccttccatctttccacccgcgatggcgagccgttgatgattgtggccaagcacgagcggggacgccctctgcttttcaaaaccaccgagggcatcaacaagtgcaccttaattgcaatggacttaggggagatgtgcgaggacaccgtgacctataagtgccccctcctcgtcaacaccgaacccgaggacatcgattgctggtgcaaccttacgtctacttgggtcatgtacgggacctgtacccagtccggggagcggcgcagagagaagcgcagcgtggccctgacgccgcactccggcatgggcctcgagacgcgagccgaaacatggatgagctccgaaggggcgtggaagcacgcccagcgagtggagtcgtggatcctgagaaaccccggcttcgcgctgctcgcaggattcatggcctacatgatcggccagaccgggatccagcgcacggtctttttcgtgctgatgatgctggttgcgcctagttacggcatgcggtgcgtcggcgtggggaaccgcgatttcgtggagggcgtcagcgggggcgcgtgggtcgacctcgtgctggaacacggggggtgcgtcactaccatggcccaaggcaagcccaccctggattttgagctcaccaaaaccacagccaaggaagtggcgcttctgcggacctattgtatcgaggcctccatctcgaatataacgaccgcgacccgctgccctacacagggggagccctacctcaaggaggagcaggaccagcagtacatctgccgacgcgacgtggtcgaccggggctgggggaatggctgcggcctatttgggaaggggggggtggtgacgtgcgccaagttcctgtgctccggcaagatcacggggaatcttgtccagattgagaacctggaatacaccgttgtagtcaccgtgcacaatggtgacacgcacgccgttggcaacgatactagcaaccacggggttaccgccaccatcacgccacgctcccccagcgtggaagttaaactacctgactacggagagctcaccttagactgcgaaccccggtccggaatcgacttcaatgagatgatccttatgaaaatgaagaagaagacctggctcgtgcacaaacagtggttcctagacctgccccttccctggaccgccggcgcggacaccagcgaggtgcactggaactacaaagagcgcatggtaacctttaaggtgccgcacgccaagaggcaggacgtgaccgtgctggggagccaggaaggcgcaatgcacagcgccctggctggagcgaccgaggtggacagcggggacggcaaccacatgttcgctgggcatctaaagtgcaaggtgcgcatggagaagctgcgcatcaagggcatgtcctacaccatgtgcagcggcaaattttccatagacaaggagatggccgagacacaacatggaaccaccgtcgtaaaggtgaagtacgagggagcgggggccccctgcaagattcctatcgaaattcgggacgtcaacaaggagaaggtagtgggccgcatcatcagcagcacccccttcgcggagaacacgaatagcgtgatcaacatagagttggagccgccctttggggactcgtacattgtgattggcgtgggcgacagcgccctcaccttacactggttcaggaaagggtccagcatcggcaaaatgtttgagtccacatatcgcggggccaagcgtatggcaatcctgggcgaaaccgcctgggacttcgggagcgtaggcggcctcttcacatccctggggaaggccgtgcaccaagtgtttggaagcgtctataccaccatgttcgggggcgtctcctggatgatccgcatcctgatcgggttcctcgtactgtggatcggcactaactcgagaaacacgagcatggccatgacgtgcatcgccgtcggcggtattactctgttcctggggttcaccgtacaagccgacatggggtgcgtggtcagctggaatggcaaggagctcaaatgtggatccggcatctttgtggtggacaatgtccacacgtggaccgagcagtataaatttcaacccgaaagcccagcgcgtttggccagcgccatcctgaacgcccacaaagacggcgtgtgcgggatccggtccactacccgccttgagaatgtgatgtggaagcagatcacaaatgagcttaactacgtactctgggagggtgggcacgacctcaccgttgtggccggcgacgtcaaaggcgtgctgaccaaagggaagcgggtgctgaccccgcccgtcaacgacttaaagtatagctggaaaacgtggggcaaagcaaagatcttcacccccgaggcgcgcaactcaaccttcttgatagacggtcccgacaccagcgagtgcccgaacgagcgccgcgcctggaacttcttcgaggtagaagactatggcttcggtatgttcaccaccaatatctggatgaagttccgggaggggtcctctgaggtatgcgatcatcgcctgatgagcgctgccatcaaagaccaaaaggctgtgcacgcagacatgggctactggatcgagagctcgaaaaatcagacctggcagatcgagaaggccagcctcatcgaggttaagacctgcctgtggcctaagacacatacgctgtggtctaacggtgtgctcgagagccagatgctgatcccgcgatcctatgccggcccgttcagccaacataactatagacaggggtacgcgacccagaccgccggaccctggcacctcggcaagctcgagatagacttcggagagtgcccaggcaccacggtcaagatccaggaggactgcgatcatcgcggaccgtcactgcgcaccactaccgcaagcggtaagcttgtgactcagtggtgttgccgttcttgcaccatgcctcccttacggttcctgggggaggacggctgctggtatgggatggagatccgccccttgagcgaaaaggaggagaatatggtgaaatcccaggtcactgcgggccagggcacatccgagacgttcagcatgggactcctgtgcttaaccctcttcgtggaggagtgcctgcggcgccgggtaacccgaaagcatatgatccttgtagtggttatcacgttctgcgcaatcatcctcggcgggctgacgtggatggacctgctccgggccctgatcatgctgggcgacaccatgtcggggcgcatcgggggccagatacacctagccatcatgaccgtgttcaaaatgagcccggggtacgtactgggagttttcctgcggaagctcacatcccgcgagacggcgctaatggtgatcgggatggccatgaccacagtgttcagcataccccacgatctgatggagctcatcgacggcatctccctaggcctgatactccttaagatcgtcacccattttgataatactcaggtaggtaccctggccctcagcctaacattcatccggtcaaccacacccttagtgatggcttggagaaccatcatggccgtcttcttcgtgatcaccttgatccccctctgccggaccagctgcctgcagaagcagagtcactgggtggagatcacggccctcatcctcggcgcccaagccctgcctgtctatctaatgaccctgatgaagggtgcgagctcacgctcatggccgctcaacgaggggatcatggccgtggggctcgtgagtctgttagggagcgcactcctgaagaacgacgtccccctggcaggccccatggtggccgggggcctcctcctggccgcttacgtgatgtccggatcgtccgccgacctcagcctggagaaagccgccaacgtccagtgggacgagatggccgatatcaccggcagttcccccatcatcgaggtgaagcaggacgaggacggcagcttcagtatacgggacgtggaggaaaccaacatgatcacgctgctcgtcaaactcgccctgataactgtgtccgggttgtacccgctggccattccagtcactatggcattatggtacatctggcaggtcaagacccagcgctccggcgcgctctgggacgtgcccagcccggcagccacgcagaaagccaccctgtccgagggggtgtaccggatcatgcagcgcggcctgtttgggaagacgcaggttggcgtgggcatccacatggagggcgtgttccacaccatgtggcacgttacacggggcagcgttatttgtcacgagacggggcgcctggaaccgtcctgggccgacgtacggaacgacatgatttcgtatggcgggggctggcgcctgggtgacaaatgggacaaggaggaagacgtccaggtgctggcgatcgaacctgggaagaacccccgccacgtgcaaaccaagccaggactgttcaaaaccctgacaggggagattggggccgtcaccctggattttaagccgggcacctccggcagccccatcatcaacaagaagggcaaggtgatcggcttatacggcaatggggttgtcaccaagtccggcgactacgtcagcgccatcacccaggccgagcgtatcggagagcccgattacgaaatcgacgaggacatattccgcaagaagagactgacgataatggacctgcacccgggcgcaggaaagaccaagagaatcctccccagcatagtgagggaggcactgaagcgccggctgcgcacgctcatcttggcccccacccgggtcgtggcagctgagatggaggaggcgctgcgagggctgcccatccggtatcaaacgccggccgtcaagagcgagcacaccggccgagaaatcgtcgacctcatgtgccacgccaccttcaccacgcggctcctttcaagcacccgcgtgcccaactacaacctcatcgtgatggacgaggcccacttcaccgatccgtgttctgtcgccgcgagagggtacataagcacacgcgtcgaaatgggcgaggccgccgcaatttttatgacggccacgccccctggttcgatcgacccttttccccagtccaacagccccatagaggacatcgagcgggagatcccggagcgatcctggaacaccggcttcgactggatcacggactaccagggtaagacggtttggttcgtgcccagcatcaaggcggggaacgacatagcaaactgccttcgtaagtctggcaagcgcgttatccagctgagccgcaagacattcgacacagagtaccctaagacaaagctcacggactgggacttcgtcgtgaccaccgacatttccgagatgggggccaacttccgggccggtcgcgttatcgacccccggcgctgcctgaagccggtaatcctgacagacgggccggagcgggtgatcttagccggccccatacccgtgacgcccgcaagcgccgcacagcgccggggccgcatcggtcgcaaccccgcgcaggaggacgaccagtacgtcttctccggcgaccccctgaagaatgatgaggaccacgctcactggaccgaggccaagatgctgctcgacaacatctacacccccgaggggatcataccaaccctgttcggcccagagcgcgagaagacgcaggccatcgacggcgagtttcggctgcgcggggagcagcggaaaaccttcgtggagctcatgcgccgtggtgacctgcccgtgtggctaagttacaaggtcgcctccgccgggataagctacaaagaccgcgagtggtgtttcaccggcgagcggaataaccagatcctggaggagaacatggaagtggagatatggacccgagaaggggagaagaagaagctgcggccaaagtggcttgacgcgcgcgtgtacgccgacccgatggccctcaaggacttcaaggagttcgccagtggtcgcaagagcacgactttggatatcttgaccgagatcgccaccctccccacctatctctcaagtaaggcgaaacttgcactcgacaacatcgtcatgctacacacgaccgaaaagggcgggcgggcctatcagcacgccctgaacgagttgcctgagtccctggagaccttaatgctcgtagccctgcttggcgcgatgaccgccgggatcttcctcttcttcatgcagggcaagggtatcggcaagctaagtatgggcctgatcgccatcgcagttgcgtccggcctcctgtgggtcgccgagatccagccgcaatggatcgccgccagcatcatccttgagttcttcctcatggtgcttttaatcccggagcccgaaaagcagcgcacaccccaggataaccagctcatttacgtgatactgaccatcctgactatcatcggcctcatagccgctaatgagatggggctgatcgagaaaaccaagacggacttcggcttttaccaggtcaagaccgagaccaccatcctcgacgtggacctccggccagcctctgcttggacgctttacgccgtggccaccaccatcctgaccccaatgctccgacacacgatcgaaaatacctccgcgaacttgtctctggccgccatcgcaaaccaggccgcggtcttgatggggctaggtaaaggctggcccctgcaccggatggatctcggggtacccctgctcgccatgggatgctactcccaggtgaacccaactaccctcacggctagtttggtcatgctgctcatacattacgccatcatcggccccggtctgcaagcgaaggcgacccgcgaggcccagaagcgtactgccgcaggaataatgaagaaccccaccgtggacgggatcaccgttatcgacctggagcccatctcctacgacccgaagtttgagaagcagcttggacaggtaatgctgctggtgctctgcgtgggccaactgctactcatgcgcaccacctgggcgttatgcgaagtcctcacccttgccacgggacccataatgaccctgtgggaggggaaccccggccgcttctggaacaccaccattgccgtcagcactgccaatatcttccgcggctcctacctcgccggcgctggcctagccttcagcctgattaagaatgcccagactccccggcgcgggactggaaccaccggggagaccctaggggagaagtggaagagacagctcaactccctggaccgcaaggagttcgaggagtacaaacgtagtggcatcctggaggtggaccgcacagaggcaaagtcagccttacgggacgggtcaaagatcaagcacgcggtctcccgcggcagctccaaaatccggtggatcgtggagcgcggaatgataaagcctaagggcaaggtggtcgacctagggtgcggccggggcgggtggtcttattatatggccaccttaaaaaacgtaacagaggtgaagggctacactaagggcggccccggtcacgaggagcccatccccatggccacctacggctggaacctcgtcaagctgcactccggcgtggacgtgttctacaagccgactgagcaggtcgacaccctgctctgcgacatcggggagagctccagcaaccctacaatagaggagggccgcacattgcgcatcctgaagatggtggagccttggttgtcttccaagcccgagttctgcataaaggtgctgaacccgtacatgcccaccgtgatcgaggagttggagaagcttcagcgtcgccacggaggctcacttgtacggtgcccactgtcccgtaatagcacccatgagatgtactgggtgtctggcgccagtgggaatatcgtcagttccgtcaatacaatctccaaaatgctcctcaaccggttcaccactcgccaccggaagcccacctatgagaaggacgtcgacctgggtgccgggacgcgcagcgtgtccaccgagaccgaaaagccggacatgacgatcataggccggcgcctgcagcggctccaggaagagcacaaggaaacgtggcattacgatcaagagaatccctatcgaacttgggcgtaccacggctcctacgaggccccttccaccggcagcgcgtccagcatggtgaacggtgtcgtcaagttactgacaaagccttgggacgtgataccgatggtcacgcagctcgccatgaccgacaccacccccttcgggcagcagcgggtgtttaaggaaaaggtggacacaaggacgccccagccgaagttgggcacccggatgatcatgactacgaccgccaactggctgtgggccctcctgggaaaaaagaagtccccgcggttgtgcacgcgagaggagtttattagtaaagtgcgcagcaacgccgctataggcgctgtgttccaggaggagcaggggtggacctcggcatctgaggctgtgaatgactccaggttttgggagctcgtcgataaagagcgcgcattacaccaagagggcaagtgcgaaagctgtgtgtataatatgatggggaagcgggagaagaaactgggcgagttcggccgagccaagggctctcgcgccatttggtatatgtggcttggcgcgcggttcctggaattcgaagctttggggttcctgaacgaggaccactggttctcgagagagaactcatggtccggcgtggagggcgagggactgcaccggctgggctatatcctcgaggacatcgacaagaaggacggggatctgatctatgctgacgacacggccggctgggatacacgcatcaccgaggacgacttactcaatgaggagctgatcaccgagcagatggcgccccaccataaaactctggcgaaggcaatcttcaagctcacataccagaacaaggtcgtgaaggtgctgcggcccacccccaagggtgccgtcatggacatcatctcccgtaaggatcagcgggggagcggccaggtcggaacatacggccttaacaccttcacgaacatggaggtgcagctcatccgtcagatggaggccgaaggggtaatcacccaggacgacatgcagaacccgaagggccttaaggaacgggtggagaagtggctgaaggagtgcggcgtggaccgcctcaagaggatggcgatcagcggggacgactgcgtcgtgaagcccctggacgagcgcttcagcacctctctcctgttcctgaacgacatgggtaaagtgcggaaggacgtaccccagtgggagccgagcaagggatggaaaaactggcaagaggtgcccttctgtagtcaccacttccataagatcttcatgaaggacggccgcagcctggtggtaccgtgccggaaccaggacgagttaatcgggagggcccggatcagtcagggtgccggctggtccctgagggaaaccgcatgcctgggaaaagcttacgctcagatgtggtccctcatgtacttccatcggcgtgacctgcgcctggccagcatggccatctgcagcgctgtgcctacggagtggttccctacctccaggactacttggagcatacacgcccagcaccagtggatgacgaccgaggacatgctcaaggtgtggaatagagtatggatagaggacaaccccaacatgaccgacaagacccccgtgcactcctgggaggacatcccctacctgggtaagagagaggacctatggtgcggaagcctcatcggcctctcctcgcgtgcgacatgggccaagaatattcacacggccataacccaggttcggaatctgattgggaaagaagagtatgtcgactatatgccggttatgaaacgctactccgcgccatccgagtccgagggcgtgctctga

SEQ ID NO: 26302 - RNA, 9867 nt, synthetic construct
  misc_feature 1..9867: note = derived and/or modified CDS sequence (opt11) from DENV-4__JQ915082__SS-prME
  source 1..9867: mol_type = other RNA
tctacaatgaccctgctctgccttattccaacggtgatggctttccatctcagcacccgcgacggcgagcctctcatgatcgtggccaagcacgagcggggccgtccgctgttgtttaagaccaccgagggcattaacaagtgcaccctcatcgcgatggacctgggggaaatgtgcgaagacaccgtgacctacaagtgccccctgcttgtaaacaccgagcccgaggacatcgactgctggtgtaacctgacaagcacctgggttatgtacgggacctgcacccagtctggggagagacggcgggagaaaagaagcgtggcgctaacaccgcattcgggtatggggctcgagaccagggccgaaacgtggatgtcttctgagggagcctggaaacacgcccagcgcgttgagagctggattctgcggaaccccggctttgcgctgctcgccggtttcatggcctatatgattggacagacggggatccagcgcatcgtcttctttgtactgatgatgttagtggcgccatcctacggaatgcggtgcgttggcgtggggaaccgcgatttcgtggaaggggtcagcggcggcgcgtgggtggatttggtgctggagcacggcggatgcgttacgaccatggcccagggcaaaccaaccttagacttcgagctcaccaaaacgaccgctaaagaggtggccctgctgcggacttactgcatagaggccagcatctcaaacatcacgacggcgactagatgcccgacccagggggaaccctacctcaaggaggagcaggaccaacagtacatatgccgtcgagacgtagtggaccgggggtgggggaacggctgtggcctgtttggcaaagggggggtcgtgacctgcgcaaagttcctgtgtagtggcaagatcactgggaacctcgtgcagatcgagaatctggagtacactgtagtggttaccgttcacaacggggacacccacgccgtcggcaacgatacgagcaaccacggagtgacagcaacaatcacgcccagatccccaagtgtggaggtcaagctgccggactatggcgaactcacgttagattgcgagcccaggtcagggatcgacttcaacgagatgatcctgatgaagatgaagaagaagacttggctcgtccacaagcagtggttcctcgacctgcccctcccctggaccgccggcgcggacacaagcgaggtgcactggaactacaaggagcgcatggtcacctttaaggtaccacacgcaaagcggcaggatgtgacggtcttgggttcccaggagggcgccatgcacagcgccctggccggtgcgaccgaggtcgattccggggacggcaaccacatgttcgccggccacctaaagtgcaaggttcggatggagaaactaaggatcaagggcatgtcctacaccatgtgctccggcaaattctcgatcgacaaggaaatggctgagacccagcacggtacgactgtcgtgaaagtgaagtacgagggcgccggcgccccctgtaaaatccccatagagattcgggatgtgaacaaggagaaggtggtgggccgcataatcagcagtacgccctttgcggagaacaccaattcagtgatcaacatagaactggagccgcccttcggggactcatatatcgtaatcggcgttggtgacagcgccctcacgcttcactggttccggaaggggtcctcgatcggcaaaatgttcgagagtacctaccgtggggccaagcggatggccattctgggagagaccgcgtgggatttcgggtccgtagggggcctgttcacctccctggggaaggctgtccaccaggtgtttggtagcgtctatacgaccatgttcgggggggtatcatggatgatccgcatcctgattgggtttctcgttctgtggatcggcaccaatagtcgaaacacctcgatggccatgacgtgcatagcagtcggtgggatcaccctgttcctaggcttcaccgttcaggccgacatggggtgcgtagtgagctggaacggcaaagagttgaagtgcgggtccggcatctttgtcgtagacaacgtgcatacctggacggagcagtacaaatttcagccagagtctccagcccgcttagccagcgccatcctgaacgcccacaaggacggcgtgtgcgggatccggagtactacccgcctcgagaatgtaatgtggaaacaaataaccaatgagctgaattacgtcctgtgggagggtggtcatgatctcacggtagtggccggcgacgtcaagggcgtgctgaccaaggggaaacgggcactgacgccgcccgtgaatgatctaaagtactcttggaaaacctggggcaaggccaagatcttcactcccgaggcccgcaactccactttcctgatcgacgggcctgacaccagcgagtgcccgaacgagcggcgcgcctggaattttttcgaggtcgaggactacggcttcgggatgttcaccacaaacatttggatgaagttccgggaggggtccagcgaggtttgcgaccacagactgatgagcgcagcgattaaagaccagaaggcggtacacgccgacatgggctattggatagaaagctccaaaaaccagacctggcaaatagagaaggccagtctcatcgaggtcaagacctgcctgtggcccaagacccacacactctggagcaacggggttctagaatcccagatgttgatcccccggtcctatgcgggcccgttcagccaacataattaccgccaggggtacgccacacagaccgccgggccctggcacctgggtaagctcgaaatcgacttcggcgagtgccccggcacaacagtcaagatccaggaggactgcgatcaccgcggtccgtcattgcgcacgaccaccgcctcaggcaagctagtgacccagtggtgctgtcgctcctgcacaatgccgcccctccgttttcttggagaggacggctgctggtatggaatggagatcagaccgctgtctgagaaagaggagaacatggtaaaatcgcaggtgactgccggccaaggcacttctgagacattcagcatgggcctcctgtgtctgactctcttcgtcgaagagtgcctgagacgtagggtcacccgcaagcacatgatcctggtcgtggtgatcaccttttgtgccatcatcctcggggggttaacgtggatggacttactccgggccctgatcatgctgggcgacacgatgtccggtaggatagggggccagatccatctcgccatcatgaccgtcttcaagatgagccccggctacgtgcttggcgtcttcctgagaaaactcacctccagagaaaccgctcttatggttatcgggatggccatgactaccgtgtttagtatcccacacgacttgatggagttgatcgacggcatctccctgggcctgatcttgttaaagatcgtaacccacttcgataacacccaggtcgggaccctggcgctgagcctgacctttatccgctccactacgcccctggtgatggcgtggcgcacgatcatggccgtgttcttcgtcatcaccctcatccccctgtgtcggaccagctgcctgcagaagcagtcccactgggtggaaatcaccgccttaattctcggggcacaggcgctgccggtgtacctaatgacacttatgaagggggcaagccgccggtcatggcctctaaacgagggcataatggccgttgggttggtgagcctactgggctccgccctcctgaagaacgacgtgccgctggcaggccccatggtggccggagggctactccttgccgcctacgtgatgagcggctcgagtgccgacctctctctggagaaggcggccaacgtacagtgggatgagatggcggatataactggatcaagccccatcatcgaggtaaaacaggacgaagacgggtcattttcgatccgcgacgtcgaggagaccaacatgatcactctgctcgtgaaattggccctgatcactgtctctggtttgtacccgctggccatccccgtgaccatggcgctttggtacatctggcaggtcaagacccagcgcagcggcgcactctgggacgtaccctcccctgctgccacccagaaggccacgctgagcgagggcgtctaccgcataatgcaacgcggactgttcgggaagacacaagtgggcgtagggatccacatggagggcgtgttccacaccatgtggcacgtgaccagaggcagtgtaatttgccacgagaccggtcgactcgaaccgagctgggcggacgtgcggaacgacatgatttcctatggtggcggttggcgcctgggcgataagtgggataaagaagaagacgtacaggtcttagcgatcgagcctggaaagaacccccggcacgtacagacgaaacccggcctcttcaaaaccttgaccggtgaaatcggcgcggttaccctggacttcaaacccggtacgagcggctctccgataatcaacaaaaagggtaaggtaatcgggctctacggaaacggggtggtaactaaaagcggcgactacgtctcagccatcacgcaggccgagcgtatcggggaacccgactacgaggtggacgaagacatcttccggaaaaagcgcctgacaatcatggacctgcacccgggtgcgggcaagacgaagagaattctccccagtatcgtgcgggaggccctcaaacggaggctgcggacgctcatactggcccccacgcgcgtcgttgccgcggaaatggaagaggccctgcggggcctgcccatcagatatcaaacccctgccgtaaaatcagagcatacgggtagggagatcgtcgacctcatgtgccacgcgaccttcaccacccgcctgcttagcagtactcgcgtgccaaattacaatctcatagtgatggacgaggcacatttcaccgacccctgtagcgtcgcagctcgaggatatatctctacgcgggtagagatgggtgaggcggccgcaatcttcatgactgctacgcccccggggagcatcgaccccttcccccagagtaactctcccatcgaagacatcgaacgcgaaatcccggagcgctcgtggaacacgggattcgattggatcaccgactaccagggcaaaaccgtctggttcgtcccatcgattaaggcggggaatgacatcgccaactgtctgagaaagtctggcaagcgagttatccagctttcccggaagacgttcgacacagagtaccccaagactaagctaaccgactgggactttgttgtcaccaccgacatctcagagatgggggctaactttcgcgcaggccgggtgattgacccacgacggtgcttgaagccggtgatactgaccgacggtcccgagcgcgtgattctcgcaggccccatccctgtaacaccggcttccgccgcccagcggcgcgggcggatagggcgcaaccccgcgcaagaggacgaccagtacgtattcagcggggaccccctgaagaatgacgaggatcacgcccactggacggaagccaagatgctgttggacaacatatacactcccgaaggaatcatcccaaccctgttcggccccgaacgagaaaagacccaggccatcgacggggagtttagactccgaggggagcaacggaagacgttcgtggaactcatgcgacgcggagacctgcccgtgtggctatcgtacaaagtcgcctcagcgggtattagctacaaagaccgagagtggtgcttcaccggcgagcgcaacaaccagatattggaggagaacatggaggtggaaatctggactcgcgagggggagaagaaaaagctgcgccccaagtggctggatgcccgggtgtatgccgacccgatggcattaaaggacttcaaagagttcgcgagcggccgcaaatctactacgttagacatcctgacagagatcgcgacccttcccacctatctgagctccaaagcaaagctggccctcgacaatatcgttatgctccataccacggaaaaagggggccgcgcctaccagcacgcgctgaatgagctccccgagtctttggaaaccctgatgcttgtagcgttactgggcgccatgaccgccgggatcttcctcttctttatgcagggcaaggggataggcaagctttccatgggtctgatcgccatcgcggtggcgtcgggcttactgtgggtcgcggagatccaaccgcagtggatcgccgcaagtataatcttagagttcttcctcatggtactgcttattcccgaacctgagaaacagcggacgccccaagataaccagttgatctacgtaatcctgactatcctgaccatcataggcctcatcgcggccaacgagatggggctgattgaaaaaaccaagacagacttcgggttctatcaggtcaagacggagaccacgatattggacgtagacctccgccctgcctcggcctggaccctatatgcagtggccactacgatcttaacgccaatgcttcgccacaccattgaaaacatgagcgccaacctatccttagccgctatcgccaaccaggcggcagtcttgatgggactggggaaggggtggcctctgcaccgaatggacctcggggtgcccttgttggccatgggctgctatagccaggttaacccgaccaccctcactgcgtccctggtcatgttgctcatccactacgccatcattgggcccggcttgcaggcgaaggcaactcgggaggcccagaagcgcacagctgcgggcatcatgaaaaaccccaccgtggacgggattactgtgattgacctggagccaatcagctatgacccgaagttcgagaagcaactcggacaggtgatgttgctggtgctctgcgtggggcagttgttgctcatgcggacaacgtgggccctgtgcgaagtcctgactctcgctaccggccccatcatcacgctgtgggagggtaatccaggccgattctggaacacgaccatcgcggtgtccaccgccaacatctttcggggcagctatcttgcgggggccggcctcgccttctccctaatcaagaacgcgcaaaccccccgccgagggacgggcaccacgggggagaccctaggagagaagtggaaaaggcaactcaactccttagaccggaaggagtttgaggaatacaagcgctccggcatcctggaggtagatcggacggaggccaagagcgcgcttcgcgacgggtcaaagatcaagcacgctgtcagtcggggctcgtcaaaaatccggtggatcgtggagcgggggatgatcaaaccgaaaggcaaggtggtggacctggggtgcggccgcggcgggtggtcctattatatggctaccctgaagaacgttacggaagtgaagggctacaccaagggcggaccagggcacgaggagccaattcccatggccacctacggctggaacctcgtcaagctgcactccggagtagacgtattctacaagccgacggagcaagtcgatactttattatgcgacatcggagagtccagctctaatcccactatcgaggaaggccgtaccttgcggattctcaagatggtggagccctggctatcgtcgaagcccgagttctgcatcaaagtgctgaacccgtatatgccaaccgtcatcgaagaactggagaagctacagcgccgtcacggcgggtccttagtgcgctgcccgttaagccgaaacagtacccatgagatgtactgggtgagtggcgcatcaggcaacatagtcagctccgtgaatactatcagcaagatgctgctcaatcggttcaccacccggcaccgcaaacctacctacgaaaaggatgtcgatctgggagcaggcacccggtcggtgagcaccgagacggagaagcccgacatgacaataatcggcagacggctgcaaaggctccaggaggagcacaaggagacatggcactacgaccaagaaaatccataccgcacctgggcctaccacgggagttacgaggcccccagcaccggctccgcttcaagcatggtgaacggcgttgtgaagctcctgaccaagccgtgggatgtgattcccatggtcacccagctcgcgatgaccgataccacccctttcgggcagcaaagggtgttcaaagagaaggttgacaccaggacgccccagccgaagctgggtacgaggatgatcatgacaacaactgccaactggctatgggccctcttggggaagaagaagtcccccagactgtgcacgcgcgaggaattcatcagtaaggtgcgcagcaacgccgccatcggggcagtgtttcaagaggagcaggggtggacatccgccagcgaggccgtgaacgatagccgcttctgggagctagtcgacaaggagcgggccctgcatcaggaaggcaagtgcgaaagttgtgtgtacaacatgatgggcaagagggagaaaaagctgggggagtttggccgcgccaagggttcccgggcaatttggtacatgtggctaggcgcccgcttcctcgagttcgaggcgctggggttcctcaacgaagatcattggttttcccgggaaaattcttggagcggcgtggaaggcgaagggctccatcggctgggatacatcctcgaagatatagataaaaaggacggggacctgatttatgccgacgacaccgcaggctgggacactagaatcactgaagacgacctgctcaacgaggaactaataaccgaacagatggcgccccaccacaagaccctggccaaagcgatcttcaaactaacctaccagaacaaggtcgtgaaggtgcttcgcccaacgcccaaaggcgccgtcatggacatcatctcacggaaggatcaacgcgggtccggccaggtaggaacctatggcctgaataccttcacgaatatggaggtgcagctcatccggcagatggaggcggagggtgtaataacccaggacgatatgcagaaccccaagggtttgaaggaacgtgtggagaaatggctcaaggagtgcggcgtggaccggctaaaacgcatggccatttccggggacgattgcgtcgtgaagccactggacgaacggttctccaccagcctcctgttcctgaatgacatgggcaaggtgcgtaaggacgtaccacaatgggacccgtcaaaggggtggaaaaattggcaggaggtccccttctgcagccaccactttcataagatcttcatgaaggacggtcgatccctcgtagtcccgtgcagaaaccaggacgagttaattggacgcgcacgcattagccaaggcgccggatggtccctccgggagacagcctgcttagggaaggcgtacgcccagatgtggtccctcatgtacttccacaggagagacctgcggcttgcctccatggccatttgctcggccgtcccaacagagtggttcccgaccagccgaacgacatggagtatccacgcgcaacaccagtggatgacgaccgaggacatgctcaaggtctggaaccgtgtctggatcgaagacaaccccaatatgacggacaaaacgcccgtgcactcgtgggaggacataccataccttgggaaacgcgaagatctgtggtgcggatctctcataggcctgtcctcccgggccacctgggccaagaacatccacaccgctatcacgcaggtgcgcaacctgatcgggaaggaggaatatgtcgactacatgccggtgatgaagcggtacagtgccccctccgagtctgaaggcgtgttatga

SEQ ID NO: 26303 - RNA, 9867 nt, synthetic construct
  misc_feature 1..9867: note = derived and/or modified CDS sequence (opt11) from DENV-4__JQ915081__SS-prME
  source 1..9867: mol_type = other RNA
agcaccatgaccctgctctgcttaatacccaccgtaatggccttccacctgagtacccgcgatggagagccgctcatgatcgtggccaagcacgagcgggggcgccccctgttattcaagaccaccgagggcatcaacaagtgcacactcatcgcgatggaccttggggaaatgtgcgaggacaccgttacctacaagtgtcccctgctcgtaaacaccgagccggaggacatcgattgctggtgcaacctgaccagcacgtgggtgatgtacggcacctgcacccaatccggggagcgtcgaagagagaagcgatctgtggccctgaccccgcactcgggcatgggcctcgagacccgggccgagacttggatgagctccgagggcgcctggaaacacgctcagcgcgtggagtcatggatactccggaaccccggcttcgcactgctcgccgggtttatggcctacatgatcggccagaccgggatccagagaattgtcttcttcgttctgatgatgctggtggccccctcctacggcatgcggtgcgtcggggtgggtaaccgggatttcgtggaaggcgtctcggggggcgcatgggtggacctagtgctggagcacggcggatgtgtcacgaccatggcccagggcaagcccaccttagacttcgagctcaccaaaacgaccgccaaggaggtggcccttctgcggacctattgcatagaggcctccatctctaacatcaccacggcgacccgctgcccgacccaaggagagccctacctaaaggaggagcaagaccagcagtacatctgccggcgagacgtagtcgaccgtggctgggggaacggctgtggcctgttcggtaagggcggagtggtgacttgcgccaagttcctgtgctccggcaagatcaccgggaacttagtccaaattgagaacctcgagtacaccgtggtggtcaccgtgcacaatggcgacacccacgccgtcggcaacgacactagcaaccatggggtgaccgctaccattacgccccggtcccccagcgtggaggtcaagctcccggactacggcgaattgacgctcgattgcgagccccggtcgggaattgatttcaacgagatgatccttatgaagatgaagaagaaaacctggctcgtgcataagcagtggttcctggacctccccttaccctggaccgccggcgcggacaccagcgaggtgcactggaattacaaggagcgcatggtcacattcaaggttccgcacgctaagcggcaggacgtgacggtcctgggatcccaagagggcgccatgcatagcgccctagccggagcgaccgaggtggactcaggggacggcaaccacatgttcgccggtcaccttaaatgtaaggtgcgcatggaaaagttaagaatcaagggcatgagctataccatgtgcagcggcaaattctccatcgacaaggagatggcagagacccagcacgggacgaccgtggtgaaagtgaaatacgagggagcgggggccccctgcaagatccccatcgagatccgggatgtcaacaaagagaaggtggttggccggatcatcagctcaacccctttcgcagagaacaccaatagcgtcatcaacatagagctggaaccgccattcggtgactcctacatcgtgatcggagtgggcgacagcgccctcacactacattggttccggaaggggtccagcatcggcaagatgttcgagtccacctatcgcggcgcgaagcggatggccatcttgggcgagacagcttgggacttcgggagcgtcggaggcttattcacttccttagggaaggccgtgcatcaggtgttcggcagcgtgtacacgaccatgttcgggggagtttcctggatgatccgcatccttatcgggttcttagtgctgtggatcggcaccaacagcagaaacacctcaatggccatgacttgcatcgcggtaggcgggatcaccctgttcctcggcttcaccgtgcaggcggacatgggttgcgtggtcagctggaacggcaaggagcttaaatgcgggtccggcatcttcgtagtggacaatgtccatacatggacggagcagtacaagttccaacccgagagcccagcgcgcctggccagcgcaatcctgaacgcccacaaggacggagtgtgcgggatacggtccactactcgcctcgagaacgtgatgtggaagcagatcacaaatgagctgaactacgtcctgtgggaaggcgggcacgacctcacggtagtggcaggcgacgttaagggcgtgcttaccaagggaaagcgggcgctgaccccgcccgtgaacgacctcaagtacagctggaagacttggggaaaggccaagatcttcacgcccgaggccaggaactccaccttcctgatcgacggccccgacaccagcgagtgcccgaacgagcggcgcgcctggaacttcttcgaagtcgaggactacggctttggtatgttcaccacgaacatctggatgaagtttcgcgagggcagcagcgaggtctgtgaccaccgcctgatgtccgccgcgatcaaagaccagaaggccgtgcacgccgacatgggctactggatagagagctcgaaaaaccagacctggcagatcgagaaggccagcctcatcgaggtcaagacctgcctgtggcccaagacgcacacgctgtggtccaatggggtgctcgaatctcagatgctgattccgcggtcctatgcggggccgttcagccaacacaactaccgccaggggtacgccacccagaccgccggcccctggcatctggggaagctcgagatcgacttcggcgaatgccccggcaccaccgtgaagatccaagaggactgcgaccaccggggaccctccctccgcacgaccaccgccagcggcaagctggtcacccagtggtgctgccgctcctgcacgatgccgccgctgcggttcttaggggaggacgggtgctggtacgggatggaaatccgtcccctatctgagaaggaggagaacatggtcaagagccaggtgaccgccggccaaggcacctcagagaccttttcgatggggctcctgtgcctaacattattcgtggaggaatgcctgcggcggcgggtgacgcgcaagcacatgatcctcgtcgtggtgatcaccttctgcgctatcatcctcggagggctgacctggatggacctgctccgggctctgatcatgctgggtgacacgatgtcagggcgcatcgggggccagatccatctcgcaatcatgaccgtcttcaagatgagccccgggtacgtgctgggcgtgttcctgaggaagctcacatcccgcgagactgccctgatggttatcgggatggctatgacgaccgtgttcagcatacctcacgacctcatggaactcatcgacggcatctccctgggcctgatcctactgaagatagtgactcacttcgacaacacccaggtagggacgctggcgcttagcctgacattcatccggtcgaccacacccctggtgatggcctggcgcacgatcatggctgtgttttttgtcatcaccttaatcccactgtgccggaccagctgcttacagaaacagtcccactgggtggagataaccgccctcattctgggcgcacaggcgctgcctgtgtacctcatgacgctgatgaagggtgccagccgccggtcatggccactgaacgagggcatcatggccgtagggctcgtgagcctgctggggagtgccctcctgaaaaacgacgtgccactggctggccccatggtcgccgggggcctcctgctcgccgcatacgttatgagcgggtccagcgcagacctctccctggagaaggcggccaacgtgcagtgggacgagatggccgacatcaccggcagcagccccatcattgaagtcaagcaggacgaggacgggagtttcagcattcgggacgtggaggaaaccaacatgatcaccctgttggtgaaactggccctcatcacggtctccggcctgtacccgcttgccatccccgtaactatggcgctatggtacatctggcaggtcaagacccagcggtcaggtgccctctgggacgttcccagccccgcggccacccagaaggccacactgagtgagggggtgtaccggatcatgcagcgggggctgttcgggaagacccaggtgggggtcgggatccatatggagggggtgttccacaccatgtggcacgtgacccgcggctccgtcatctgtcacgagaccggccgactggagccaagctgggcggacgtgagaaacgatatgatctcctacggcggcggctggagattgggcgacaagtgggacaaggaggaggacgtccaggtcctagccatagagccgggcaagaacccccggcacgtgcagaccaagcccggcctcttcaaaacacttactggggagatcggtgccgtcacactggacttcaagccggggacgtcaggctcccctatcatcaacaagaaaggcaaggtcatcgggctctacggcaacggcgtggtgacaaagagcggcgactatgtctccgccatcacgcaggcggagagaatcggggagccggactacgaggtggacgaggacatcttccggaagaagcgattaaccataatggacctgcacccgggcgcgggcaagacgaagaggattttaccaagcatcgtcagggaggcccttaagcggcgcctacggaccctcatcttggcccccacccgtgtagtggcagcggaaatggaagaagcgctacgtgggctacccatccgctatcagacaccggccgtgaagtccgagcacacgggcagagagatcgtcgacctcatgtgccacgcaactttcaccactcgcctgctgagctccacccgtgtgcccaactataacctcatagtgatggatgaggcccacttcaccgacccctgctcagtcgcagccagggggtacatcagcacccgagtagaaatgggcgaggcggctgccatattcatgaccgcaacgcccccggggagcatcgacccattcccccaaagcaactcgcccatcgaggacatcgagcgcgagatcccggagcggagctggaacacaggcttcgactggatcaccgactaccagggcaagaccgtctggtttgtgccctccatcaaggccgggaacgacatcgccaactgtctgcgcaagagcggcaagcgcgtaatccagctatcccggaagacgttcgacaccgagtaccccaaaactaagctgaccgactgggactttgtagtgacgaccgatatcagcgagatgggggctaatttccgcgccggacgggtgattgacccccgccggtgtttaaagccggtcatcttgacagacggtccggagcgcgtgatactcgctggaccgatccccgtcactcctgcctccgccgcccagagacgcggccggatcgggcgtaatcccgcacaggaggacgaccagtacgtattcagcggcgaccccctcaagaacgatgaggatcacgcccactggacggaggccaagatgctgctcgataacatctacacgcccgaggggatcatcccgacccttttcggccccgagcgggagaagacccaggcaatcgacggcgagttccgcctgcggggggagcagcgcaagaccttcgtggagctcatgcggcgcggagacctgcccgtttggctgtcctataaggtcgctagcgcgggaatctcctacaaggaccgagagtggtgcttcacaggcgagcggaacaaccagattctcgaggagaacatggaggtggaaatctggaccagagagggagagaagaagaagctgcgcccgaagtggttagacgcccgggtgtacgctgacccgatggccttgaaggacttcaaggagttcgccagcggccgcaagtccaccacgctggacatccttaccgaaatcgcgaccctccccacctacctgagctctaaagccaagctggctctcgataacatagtcatgctgcacaccacggagaagggcgggcgcgcctaccagcacgccctgaacgagttacccgagtcactagagacgctgatgctagtcgcactgctgggcgctatgaccgccggtatcttcctctttttcatgcagggcaaagggatcggtaagctgtccatgggcctgatcgctatcgcggtggccagcgggctcctgtgggtcgccgagatacagccgcagtggatcgcagcctccatcatcctggagtttttcctcatggtactgctgatccccgagcccgaaaagcagcgtacgccccaggacaaccagctaatctacgtgatcctgacgatactcaccatcattggcctcatcgcggcgaatgagatggggctgatcgagaagaccaagaccgacttcggcttttaccaggtcaagacggagaccactatcctggacgtggacctccgcccggctagcgcctggaccctgtatgccgtggcaaccaccattctgacccccatgctccggcacacgatcgagaacatgagcgccaacctgtccctggccgccatcgccaaccaggcggccgtgctgatggggctggggaagggctggcccctgcacaggatggatttaggggtacctctgctggccatgggctgctattcccaggtgaacccgacgaccctcaccgcctcgctggtcatgctgctcatccactacgctatcatcgggcccggcctgcaggccaaggccacccgggaggcccagaagcgcacggccgcgggcattatgaagaaccccacagtggacgggatcactgtcatcgatctggagcccatctcctacgacccaaagtttgagaagcagctaggccaggtaatgctcctcgtgctctgtgtggggcagctgctgctcatgcggaccacgtgggcgctgtgcgaggtactgaccttggccactggccccataatcaccctgtgggaggggaatcccggacgcttttggaacacgacgatcgcggtgtccaccgccaacatcttccgtggctcctacctggccggggccggcctcgccttttccctgataaaaaacgcccagacgccccgccgggggacgggcaccaccggggagaccctgggcgagaaatggaagcgtcagctcaactccctagacaggaaggagtttgaagagtataagcgctccggcatcttagaggtggatcggacggaggccaaatcagctctccgcgacgggtccaagatcaagcatgccgtctctcggggttccagcaagatccgctggatcgtggagcgggggatgatcaagccgaagggcaaggtggtcgacctgggatgtggccgcggcgggtggtcctattatatggccaccttaaagaacgtgaccgaggtgaagggctacaccaagggtggccccgggcacgaggagccaatccccatggccacctatggctggaacctcgtcaagctgcacagcggcgtggacgtgttctacaaaccgacggagcaggtagacaccctgctatgcgacatcggggagtccagctccaaccccaccatcgaggagggcagaaccctgcggatcctcaagatggtggagccctggctcagcagcaagccagaattctgcataaaggtgctgaacccgtacatgcccacggtcatcgaagagctggagaagctacagcgccggcatgggggatccctggtgcgctgccccctgagccggaactccacccacgagatgtactgggtgagcggtgcatccggcaacatcgtcagctccgtgaacaccatcagcaaaatgctgctaaacaggttcaccacccgccatcgcaagccgacatacgagaaggacgtcgacctgggcgcggggacccggtccgtgagcatcgagaccgaaaagccggacatgacgatcatcggccgccggctacagcgtctccaagaagagcataaggaaacctggcactacgaccaagagaacccctaccggacctgggcctatcacgggtcctacgaggcccccagcaccggctccgccagcagcatggtgaacggggtcgtgaagctcctgacgaagccgtgggatgtgatccccatggtcacccagcttgcgatgaccgacaccacgccgttcgggcaacagcgcgtcttcaaggagaaggtcgacacccggacgccccagccgaagctgggcactcgcatgatcatgacgacgaccgccaactggctgtgggccctcctggggaagaaaaagtccccgcggctctgcactagggaggagttcatctccaaggtacggagcaacgccgccatcggtgcggttttccaggaggagcagggctggacgtccgcctccgaggccgtgaacgatagccgcttctgggaactcgtcgacaaggagcgggccctgcaccaggagggcaagtgcgaatcctgcgtgtacaatatgatgggcaagcgcgagaagaaactgggggagtttgggcgcgccaaggggagccgggctatctggtacatgtggctcggcgcccgcttcctcgagttcgaggccctggggttcctcaacgaggaccactggttctcacgggagaacagctggtccggcgtggagggcgagggtctccaccgcttgggctacatcctcgaggacatcgacaagaaggacggggacctaatctacgccgacgacaccgccggctgggacacccggataacggaggacgacctgcttaatgaggagttaatcacggagcagatggcgccccaccacaagaccctggccaaggccatcttcaaactcacctatcagaacaaggtcgtgaaagtgctgcgccccactcccaagggagccgtcatggacattatcagccggaaagaccagcgggggtccggccaagtggggacgtacggcctgaatacgttcaccaacatggaggtgcagttaatccgccagatggaagcggagggggtcataacccaggacgacatgcagaacccaaaaggactgaaggagcgcgtcgagaagtggttgaaggaatgcggcgttgaccggctcaagcgcatggcaataagcggcgacgactgcgtcgtgaagcccctggacgaacggttctccacctcgctcctgttcctgaacgatatgggcaaggtgcgcaaggacgtcccccagtgggacccgagcaaggggtggaagaactggcaagaggtgcccttctgttctcaccacttccacaagatcttcatgaaagacggccggtccctggtggtcccctgtcgcaatcaggacgaattaatcggtcgggcacgcatctcacagggcgccggttggtccctgcgggagacggcctgcctggggaaggcgtacgcccagatgtggagcctaatgtacttccaccgacgagacctgcgcctggcatcaatggccatctgcagcgccgtgcctaccgagtggtttccgacctctcgcaccacgtggagtatccacgcacagcaccagtggatgaccaccgaggacatgctcaaggtgtggaaccgggtctggatcgaggataaccccaatatgactgacaagacaccggtgcactcgtgggaagacatcccatacctgggcaagcgcgaggacctgtggtgcggctcgctcatcggcctaagctcccgcgcaacctgggctaaaaacattcacaccgccatcacccaggtgagaaacctgatagggaaggaggagtacgtcgattatatgccggtgatgaagcggtacagtgccccgtccgaaagcgagggcgtgctctaa

SEQ ID NO: 26304 - RNA, 9867 nt, synthetic construct
  misc_feature 1..9867: note = derived and/or modified CDS sequence (opt11) from DENV-4__JQ915084__SS-prME
  source 1..9867: mol_type = other RNA
agcaccatgaccctgctctgcctgatcccgaccgtgatggccttccacctgagtacccgcgacggcgagccgctcatgatcgtggccaagcacgaacgggggcgcccgctgctgttcaaaaccacagagggcatcaataagtgcaccctcatcgcgatggacctgggggaaatgtgcgaggacacggtgacctacaagtgccccttgctcgtcaacaccgagcccgaggacatcgactgctggtgcaacctgaccagcacctgggtaatgtacgggacctgcacccagtccggggagcggcgccgggagaagcgcagcgtggcgctgacgccacactccggcatgggcctcgagacccgggccgagacctggatgtcctctgaaggggcgtggaagcacgcccagcgtgtcgagagctggatcctacggaatcccggcttcgcactgctagccggatttatggcttacatgattggacaaaccgggatacagcgcatcgtgttcttcgtgctgatgatgctagtggcccccagctatggcatgcgctgtgtaggggtagggaacagagacttcgtggaaggcgtctcggggggcgcgtgggtggacctcgtgttagagcacggcgggtgcgtcacaaccatggcccagggcaagcccaccctggacttcgaactcaccaagacgacagccaaggaggtggccctcctgcggacctattgcatcgaggcctccatcagtaacatcacgaccgcgaccagatgccctacccagggggagccctacctcaaggaggagcaggaccagcagtacatttgccggcgcgacgtggtcgacagaggctgggggaacggctgcggactgtttgggaagggcggcgtggtgacctgtgccaagttcttgtgctccggaaagattacggggaatctagtacagatcgaaaacctggaatacaccgtggtggtcacagttcacaacggggacactcacgccgtcggcaacgacacgagcaatcacggggtgacagctaccatcacgcccagatcccccagcgtagaggtcaagctgccggactacggggagctcacgctggactgcgagccccggtccgggatcgatttcaacgaaatgatcctgatgaagatgaaaaagaaaacatggctcgtgcataaacagtggttcctggacttgcccctcccctggacagccggcgcggataccagcgaggttcactggaactataaggagcgcatggtcactttcaaggtgcctcatgcaaagcggcaggacgtcacggtcctaggtagccaggagggcgcaatgcacagcgccttagcaggcgcgaccgaggtagactccggggacgggaaccacatgttcgccgggcatctcaagtgcaaggtgaggatggaaaagttacgcatcaagggcatgtcttacaccatgtgcagcggcaagttttccatcgacaaggagatggcggagacccagcatgggacgaccgtcgtgaaggtgaagtacgagggcgccggggccccctgtaagattcccatagaaattcgggacgtcaataaggagaaggtggtaggccgcatcatcagcagtacccccttcgcggagaacaccaacagtgtcatcaatatcgagctggagccgccgttcggagactcctatatcgtgattggtgtgggcgacagtgccctcacactgcactggttccgcaaggggtcatcaatcggaaagatgttcgagtccacctaccgcggggccaagcggatggccatcctgggcgagaccgcgtgggactttgggagtgtaggcggcctgttcacctccctggggaaggccgttcaccaggttttcggcagcgtgtacactaccatgttcgggggcgtgagctggatgatccgcatcctgatcgggttcctcgtcctgtggatcggcactaacagccggaacacttccatggccatgacgtgcatcgcagtcggcgggataaccctgttccttggcttcaccgtgcaggccgacatggggtgcgtcgtcagctggaatggcaaggagctcaagtgcgggtccggcatcttcgtggttgacaatgtccacacttggacggagcagtacaagttccaacccgagagccccgcgcgcctggccagtgccatcctaaacgcgcacaaggacggcgtgtgcgggatacggtccaccacccgtctcgagaacgtgatgtggaagcagatcactaacgagctgaattatgtcctgtgggaaggtgggcacgacctgacggtggtggcaggcgacgtcaagggcgtgttaaccaaggggaagcgggcgcttacaccgcccgtgaacgatctcaagtattcatggaagacgtggggcaaggccaagatctttacgcccgaagcccgcaactctacctttctgatcgacgggcccgatacgtcggaatgtccgaatgagaggcgcgcatggaacttcttcgaggtcgaggattacggcttcggtatgttcaccacgaacatttggatgaagttccgggagggctcaagcgaggtgtgcgaccaccgactgatgagtgccgcgatcaaggaccagaaggcggtgcacgccgatatgggctactggatcgagagctccaaaaaccagacctggcagattgagaaggccagcctcatcgaggtcaagacctgcctgtggccaaagacccacacgttgtggtccaacggggtgctcgagtctcagatgctgatcccccggtcctacgcggggccgttcagccagcacaactacaggcagggctacgccacccagactgccggcccctggcacctggggaagctggagatcgatttcggagagtgccccggcaccaccgtaaagatccaggaagattgcgaccaccgggggcccagtctgcgcacgacaaccgcaagcggcaaactggtcacccagtggtgctgtcgctcctgcacgatgccgcccctccggttcctaggggaggacggctgctggtacggaatggagattcgccccctgagcgaaaaggaggagaacatggtaaaaagccaggtgaccgcggggcagggcacctccgagacctttagcatggggctcctttgcctgaccctcttcgtcgaggaatgcctgcggagaagagtgacccgcaagcacatgatcttagtcgtggtgatcaccttctgcgcgattatccttggcggcctcacctggatggacctgctccgggcgctgataatgctgggcgacacgatgtccggccgcatcgggggccagatccacctggcgatcatgaccgttttcaagatgagccccgggtacgtgctgggcgtgttcctgcggaagctcacatcacgagagaccgcactgatggtcatcgggatggccatgacgaccgtgttctctatccctcatgacctgatggagctcatcgacggcatttccctgggactgatcctactgaagatcgtgacccacttcgacaacacccaggtcgggacgctggcgcttagcctgaccttcatgcggtccaccacgcccctggtgatggcttggcgcaccatcatggccgtgttcttcgtcatcacactcatcccgctgtgccggacaagctgtctgcagaagcagtcccactgggtagagataaccgccctcatccttggcgcccaggcgctgccagtgtatctcatgacgttaatgaaaggggccagcaggcggtcctggccactgaacgagggcatcatggcagttggcctcgtgagcttgctgggctcggccctcctgaagaacgatgtgccactggcgggcccgatggtcgccgggggtctcctgctggccgcctacgtgatgagcgggtccagcgccgatctatccctggagaaggcggccaacgtgcagtgggacgaaatggctgacatcaccggcagcagtcccatcatcgaggtcaagcaggacgaggacggatcatttagcatcagggacgtggaggagacgaacatgataaccctgctcgtgaagctggccctgattacggtctccggcctctacccgctcgccatccccgtgaccatggcgctgtggtacatctggcaggtcaaaactcagcggtcgggagcactctgggacgtcccttcccccgccgccacccagaaggccactctgagcgagggggtgtaccggatcatgcagcggggcctttttgggaaaacccaggtgggcgtcgggatccacatggagggcgtgttccacaccatgtggcacgtcacccggggctccgtcatctgccacgagaccgggcgactcgaaccgagctgggcggacgtgcgcaacgacatgatctcctacggggggggctggcgcctgggggataagtgggacaaggaggaggatgtgcaggttctggccatcgagcctgggaagaacccccgtcacgtgcaaacgaagcccggattgttcaagaccctgaccggggagatcggagcggttaccttagacttcaaacccggcacgtccggctctcccatcattaacaagaaaggcaaagtgatagggctctacggcaacggggtggtgaccaagagcggcgactacgtctccgcaatcacccaggccgagcgtatcggggagcctgactatgaggtagacgaggacatcttcagaaagaaacgcctaacaatcatggacctccacccgggcgcgggcaagacgaagagaatcctcccgtccattgtgagggaggccctgaagcggcgcctgcggaccctcatcctggcccccacccgcgtggtggccgcggagatggaggaggcactgcgtgggctgcccatcaggtaccagacgccggctgtgaagtccgagcatacgggtcgggagatcgtcgacctcatgtgccacgctacctttaccacccgcctactgtcgtctacgcgggtgcccaactataaccttatcgtgatggacgaggcccacttcaccgacccctgcagcgtcgcggctcgcgggtacatctccacccgggtggagatgggggaggctgccgccatctttatgaccgccacgccgccggggagcattgacccgttcccccagtctaattcccccatagaggacatcgagcgggagattccggagcggagctggaataccggcttcgactggatcaccgattaccagggaaaaacagtctggttcgtgccctccatcaaggccgggaacgacatcgccaactgcctgaggaagtcaggcaaacgcgtgatccagctctcccggaaaacgttcgacaccgagtaccccaagaccaagctgaccgactgggacttcgtcgtgacgaccgatataagtgaaatgggggccaacttcagagccggccgggtgattgacccccgccggtgcttgaagccggtcatcctaaccgacgggcccgagcgcgtgatcctcgccggccccatccccgtaaccccggcatccgccgcccagcggcgcggacggatcgggaggaaccccgcgcaggaggatgaccagtacgtctttagcggagacccattgaagaacgacgaggaccacgcacactggacggaggccaagatgctgctcgacaacatctacacccccgagggcatcataccgaccctgttcggccctgaacgggagaagacccaagccatcgacggcgagttccgcttgcgcggggagcagcgcaagacgttcgtggagctcatgcggcgcggcgacctgcccgtgtggctgtcctacaaggtagccagcgcggggatctcctataaggaccgggagtggtgcttcaccggcgagcgcaacaatcagatcctcgaggagaacatggaggtggagatttggacccgggagggggagaaaaagaaactgcgccccaagtggctggacgctcgggtgtacgccgacccgatggccctcaaggacttcaaggagtttgccagcgggcgcaagtcaaccacactggatatcctgaccgaaatcgctaccctccccacatacctgtcttccaaggccaagctggccctcgacaacatcgtcatgctgcatacaactgagaaaggcgggcgcgcctaccagcacgccctgaacgagctcccagagagcctggagaccctaatgctcgtggcgcttctgggcgccatgaccgcagggatctttctcttcttcatgcagggcaaggggatcggcaagctctctatgggcctgatcgcgatagcggtcgcgagtgggctcctgtgggtcgccgaaatccagccgcaatggatcgccgcctccataatcttggagttcttcctcatggtgctgctgatccccgagcccgaaaaacagagaacgccccaggacaaccagctcatctacgtgatcctgacgatcctggcgatcatcggcctcatcgccgccaatgaaatggggctgatagagaaaaccaagacggacttcggtttctaccaggtcaagacggagacgactatcctggacgtagacctccgcccggccagcgcctggaccctatacgcggtggcgaccaccatcctgacccccatgctacggcacaccatcgagaacaccagcgctaacctgtccctggcagccatcgcgaaccaggccgcagttctcatggggctgggcaagggctggcccctacaccgcatggacctcggggtgcccctgctggccatggggtgctactcccaggtgaacccgacgaccctaacagcatccctggtcatgctcctaatccactacgccataatcgggccgggcctacaagccaaagccacccgggaggcccagaagcgaacggcggccggcatcatgaagaaccccaccgtggacgggatcaccgtgatcgacctcgagcccatcagctacgaccccaagttcgagaaacaactcggccaggtcatgctgttagtgctctgcgtggggcagctgctgctcatgcgcaccacgtgggccctgtgcgaagtcctgaccctcgccacaggccccatcatgaccctgtgggaggggaaccccggcagattctggaacacgaccatcgctgtgagcaccgcaaacatattccgggggagttacctggctggtgcaggactcgccttctccctgatcaaaaacgcccagacgccccgccggggtacgggcaccaccggagagaccctcggcgagaagtggaagcgccagctcaacagcctggaccggaaagagttcgaggagtacaagcgttccggcatcctggaggtggaccgcacagaggctaagagcgctctccgcgatgggagcaagatcaagcacgctgtcagccgggggtccagtaagattcgctggatcgtagagcgggggatgatcaagccgaagggaaaggtggtcgaccttgggtgtggccgcggcgggtggtcctactacatggccaccctgaagaacgttacagaggtgaaaggctacaccaagggaggccccgggcacgaggaacccatccccatggccacctacggctggaacctcgtcaagctgcacagcggcgtggacgtgttctacaaacctacggagcaggtcgacacactgctctgcgacatcggggagtccagcagcaaccccacaatcgaggagggccgcacactgaggatcctgaagatggtggagccctggctcagttctaaacctgagttctgcattaaggttctgaatccgtacatgcccacggtcatcgaggagctggagaagctacagcgccggcacggggggtccctggtgcgctgtcccctgtcgcggaactccacccacgagatgtactgggtgagcggcgcgtccgggaatatcgtcagctccgtgaacactatctcaaagatgctgcttaaccgctttacaacgaggcatcgcaagcccacctacgagaaggacgtagatctgggcgcagggacccggtccgtgagcaccgaaacggagaagccggacatgaccatcattggccgccgtctgcagcgcctccaggaagagcacaaagagacctggcactacgaccaggagaacccttaccggacttgggcctaccacgggtcttacgaagcgcccagcacgggcagtgcgtcatccatggtgaacggggtagtgaagcttttaacgaagccttgggacgtgataccgatggtcacccagctcgccatgaccgacacgacccccttcgggcagcagcgcgtgtttaaggagaaagtagacacccggacgccccagccgaaaatcggtacgcgcatgatcatgacaaccaccgccaactggctatgggccctgctcggtaaaaagaagtccccgcggctttgcactcgggaggagttcatctccaaagtccggagcaatgcagctatcggcgccgtgtttcaggaggaacagggctggacgagcgccagcgaggccgtaaacgacagccgcttctgggagttagtcgacaaggagcgggccctccaccaggagggcaagtgcgagtcctgtgtttacaatatgatggggaagagggagaagaagctgggggagttcggccgcgcgaaaggttctagagccatctggtacatgtggctgggggcccgcttcctagagttcgaggccctggggttcctgaacgaggatcactggttctcccgggaaaacagctggtccggcgtggagggcgaggggctccacagactgggctatatcctggaagacattgacaagaaggacggggacctgatctacgccgacgacaccgcaggctgggacacccggatcacggaggacgacctactgaatgaggagctcattaccgagcagatggcgccccaccacaagaccctagccaaggccatcttcaagcttacctaccagaataaggtcgtaaaggtgctccgccccacgcccaaaggcgcggtcatggacatcatcagccggaaggaccagcgcgggagcggccaggtaggaacctacgggctgaacacctttaccaacatggaagtgcagctgattcgccaaatggaggcggagggggtcatcacccaagacgacatgcagaaccccaagggcctcaaggagcgtgtggagaagtggctgaaggaatgcggcgttgaccggctgaagcgcatggcaatcagcggggacgattgcgtcgtgaagcccctcgacgaacggttctccacgagcctgctattcctcaacgacatgggcaaagtacgaaaggatgtcccccagtgggagccttcaaaggggtggaagaactggcaggaagtgcccttttgtagccaccatttccataagatcttcatgaaggacggccgatcgctggttgtcccctgccgcaatcaagatgagctgatcgggagagcccgcataagtcagggtgctggctggtccctccgggagactgcgtgccttgggaaagcctacgcacaaatgtggagcttgatgtacttccaccgccgtgacctccggctcgcttccatggccatctgcagcgcggtgcccaccgagtggttcccgacgagccgcacgacatggtccatccatgcccaacaccagtggatgaccaccgaggacatgctgaaggtttggaaccgtgtctggatcgaggacaaccccaatatgacggataagacccccgttcacagctgggaggacatcccctacctcggaaagcgcgaggacctgtggtgcgggtccctgatcggcctctcatcccgggccacctgggccaagaacatccacaccgccatcacgcaggtgcgcaacctgatcgggaaggaggagtacgtcgactacatgccggtgatgaaaaggtacagctccccctcggaatcagaaggcgtgctgtag

SEQ ID NO: 26305 - RNA, 9867 nt, synthetic construct
  misc_feature 1..9867: note = derived and/or modified CDS sequence (opt11) from DENV-4__KM190936__SS-prME
  source 1..9867: mol_type = other RNA
agcaccataaccctgttatgcctgattcccaccgttatggccttctccctgtccacccgcgacggggagccgctcatgattgtggcaaagcacgagcgggggcggccgctgctgttcaaaaccaccgagggaatcaacaagtgtacactaatcgcgatggacctcggggagatgtgcgaggacaccgtgacctataagtgccccctgctggtgaacacggaaccggaagacatcgactgttggtgcaacctgaccagcacctgggtgatgtatggaacctgcacgcaaagcggtgagcggcgccgggagaagcgtagtgtggccttgaccccgcactctggaatgggcctcgaaacccgggcggagacgtggatgagcagcgagggcgcttggaagcatgcccagcgcgttgaatcctggatccttcggaatcctggctttgcgctactcgcaggtttcatggcctacatgattggccagaccggcatacagcgcaccgtgttcttcgtacttatgatgctagttgccccgagctacgggatgcggtgtgttggcgtgggcaacagagatttcgtggaaggcgtctccggcggcgcgtgggtggacttagtactggagcatggggggtgcgtcacaacgatggcgcaaggcaaacccaccctggactttgaactaactaagaccacggcaaaagaggtggccctgctgagaacctactgtattgaagcctccatttccaacatcacgaccgcgactcgctgtcccacccaaggagaaccgtacttaaaggaagaacaggaccagcaatacatctgtcgcagggacgtcgtcgaccgaggctgggggaatggctgcggactattcggcaaaggcggggtggtcacttgcgccaagttctcgtgcagcggcaagatcaccggtaatcttgtccagatcgagaatttagagtataccgtggtggtcaccgtgcacaacggggatacccatgccgttggcaatgacacctctaaccacggggtgacggccatgatcacgccgcggtcccctagcgtagaggtcaagttaccggactacggtgagctcacgttagactgcgaaccacgctcggggatcgacttcaacgagatgatcctcatgaagatgaagaagaagacttggttagtgcacaagcaatggttcctcgacttgcccctgccctggaccgccggcgcagacacctctgaggtgcactggaactacaaggagaggatggtgaccttcaaggttccccacgccaagcgccaagacgtgacagtcctcgggagccaagaaggggctatgcattccgcccttgccggcgcgaccgaggttgacagcggggacggcaaccacatgttcgccggtcacctgaaatgcaaagtgagaatggagaagttgaggattaagggaatgtcctataccatgtgtagcggcaaattttccattgacaaggaaatggcagagactcaacacgggaccaccgtcgtgaaggtgaaatacgagggagccggggccccctgcaaagttccgatcgagattcgagatgtaaacaaagagaaggtggtaggcagaatcatcagctcgacgcccctcgcggagaatacgaacagcgtcacgaacatcgagctcgagcctcccttcggggactcctatatcgtgatcggcgtcggcaacagcgccctcacccttcactggttcagaaaggggtccagcattggaaagatgttcgaatccacctatcgcggcgccaaacggatggccatcttaggcgagaccgcttgggacttcggaagcgtcggcggcttgttcacctccctgggaaaagccgtgcaccaggtcttcggaagcgtgtacaccaccatgttcggcggcgtgtcctggatgattaggatactgatcggtttcttggtcctttggatcgggaccaacagccggaacacctcgatggcaatgacctgcatcgccgtgggcgggataaccttattcctggggttcactgtccaagcagacatgggttgcgtggtatcgtggagcggaaaggagctcaagtgtgggtccggaattttcgtggtcgacaacgtgcacacatggacggagcagtataagttccagcccgaaagcccagcccgcctggcctctgccatcctgaacgcccacaaggatggcgtgtgcgggatacggagcactacccgcctcgagaacgtcatgtggaagcaaatcacgaatgagctaaactacgtgctgtgggagggagggcatgacttgaccgtagtagctggagacgtgaaaggcgtgcttactaagggaaagcgggctctcacgcctcccgtctcagacttgaaatatagttggaagacgtggggcaaagccaagatcttcacccccgaagcacgcaatagcacgttcctgatcgacgggcccgacacgtctgagtgtcctaacgagagacgtgcgtggaactccctcgaggtggaggactacgggttcgggatgttcacgacaaacatatggatgaagttccgcgagggctcttccgaggtttgtgaccatcggctcatgagcgccgcaatcaaggaccagaaggcggtccatgccgacatgggctactggattgagtctagcaagaaccagacctggcagatcgagaaggcttcgctaatcgaagtaaagacctgcctgtggcccaaaacacacaccctctggagcaacggggtgctggagtcgcagatgctgatccccaagagttacgcggggccgttctcccagcataattaccgtcaggggtacgccacacaaacggtcggaccctggcacttaggaaagctggagatcgacttcggcgagtgtccgggcacaacggtgaccatacaggaggattgcgaccatcgcgggccgtccctcaggaccaccaccgcttctgggaagctcgtgacccagtggtgctgccgcagctgcactatgccgcccctgaggttcttgggggaagatggctgctggtacggtatggaaatccggcccttatccgaaaaggaggagaatatggtcaagagtcaggtgactgccgggcaaggaacttccgagacgttctccatggggctgctgtgcttaacactgttcgtcgaggagtgcctgcggcggcgcgtgacccggaagcacatgatcctcgttgtcgtgatcacgttgtgcgcgattatactaggcgggctcacctggatggacctgttgcgcgcgctaataatgcttggcgacaccatgagcggccggataggcggccagatccacctcgccatcatggccgttttcaagatgtctccaggctacgtccttggcgtgtttcttcgcaagttaaccagccgtgaaactgcgctcatggtgatcgggatggccatgaccacggtactgtctatcccgcacgacctgatggagctcatcgatggcatcagcctgggtctgatcctccttaagattgtgacacagtttgacaacactcaagtggggactctagcgttgtccctgacattcatccgcagcaccatgcccctagttatggcgtggcggacaatcatggccgtcctattcgttgtgaccctcatccccctgtgtcggacctcttgcctccaaaagcagagtcattgggtggagatcaccgccctgattcttggcgcgcaggctctacctgtgtatttgatgacactgatgaagggggcgtcacggcgcagctggcccctcaatgaaggcataatggccgtagggcttgtgtctctgctaggcagtgccctgctgaagaatgacgttcccctcgcgggccctatggtcgccggtggcctgctcctagcagcctatgtcatgagcggatcctccgctgacctaagcctagagaaggctgccaacgtgcagtgggacgaaatggccgacatcaccggcagctcccccatcatcgaggtaaaacaggacgaggacgggtccttctccatccgggacgtcgaagagaccaacatgatcaccctcttggtgaagctggcccttattacggtcagcggcctgtaccctcttgctattccggtgaccatgaccctgtggtacatgtggcaagtgaagactcagcgctctggcgcgctgtgggacgtgccgagccccgcggccacgcagaaggccgcgctgtccgagggtgtataccggatcatgcaacgaggcctattcgggaaaacccaggtgggcgtcgggatccatatggagggcgttttccataccatgtggcatgttactcggggaagcgtcatttgccacgaaaccgggcggctggaaccatcctgggcggacgtacggaatgacatgatctcctacggggggggctggcgcctaggcgacaagtgggacaaagaggaggacgtgcaggtcctagccattgagcccggaaagaatcccaagcatgttcagacgaagcccggcctattcaagacactgaccggggagatcggcgctgtgaccctggacttcaagccggggacttcgggaagcccaatcatcaaccgcaagggaaaggtcataggattatacggtaacggtgtggtgaccaagtccggcgactacgtctcggccattacccaagccgagcgtatcggagagcccgactacgaggtggacgaagatatcttccgcaagaagcggctcaccatcatggatctccatccgggcgcgggcaagacgaagcgcatcctgccctcaatcgtaagagaggccttaaaacggcggctgcgtaccctcattcttgcccccactcgtgtggtcgccgcggagatggaagaggccctgcgtggactacctatccgttatcagaccccggccgtcaaatctgagcatacaggccgcgagattgtcgacctgatgtgccacgccaccttcaccacgcggttgctcagctccacgagagtgcctaactacaacctgattgtcatggacgaggcgcatttcaccgatccgagctccgtggccgcccgtggctacatcagcacccgcgtcgagatgggggaggctgccgccatcttcatgacggctacaccaccgggcgccaccgacccgttcccccagtcaaacagccccatcgaagacatcgagcgggaaattccggaacgctcctggaacactggctttgactggatcacagactatcagggcaagacggtctggttcgtgccaagcatcaaagcgggtaacgacatcgccaattgcctgcgaaagtccggcaagaaagtcatacagctcagtcgcaaaacttttgacaccgagtacccaaagactaaactgacggactgggacttcgtcgtaacgaccgacatctccgagatgggggccaacttccgcgcgggccgggtgatcgacccccgccggtgcctaaagccagtaatcctcacggatgggcccgaacgcgttatcctggccggccccatccccgtgacgccggcctccgctgcgcagaggagaggcagaataggtcgcaaccccgcccaagaggacgaccagtacgtgttctccggggacccactaaagaacgacgaggaccacgcccattggaccgaggccaagatgctcttagacaatatttacaccccggaggggatcatcccgactcttttcggacccgagcgggagaaaacgcaggccattgatggagagttccgcctccggggggaacagagaaagaccttcgtagagctgatgcggcgcggcgacttgcctgtgtggttgagctacaaggtcgctagtgccgggatcagctacaaggacagggagtggtgtttcacaggcgagcgaaataatcagatcctggaggagaacatggaggtggagatctggacccgggaaggggagaagaagaaactgcgcccccggtggctcgacgcccgcgtgtatgccgacccgatggcgcttaaggacttcaaagagttcgcgtcggggcgtaaatccatcacactggatatccttaccgagatcgcaagtcttcccacctacttaagcagtagagccaagctcgccttggacaacatcgtcatgttgcacaccaccgaaaggggcgggcgggcctaccaacacgcgcttaacgaactgcccgaatcactggagacgctcatgttggtggcccttcttggcgccatgaccgcaggcatcttcctcttcttcatgcaagggaagggaattggaaagctgagcatgggcctgatcaccatcgcggtggctagcggccttctgtgggtcgccgagattcagccgcaatggatcgccgccagtatcattctagagttctttctgatggtcttgctcatccccgagcccgagaagcaacgcacgccccaagacaaccagctgatctacgtgatcctgacgatactcaccatcataggcctgattgcggctaacgagatgggcctgatagagaaaacgaagactgatttcgggttctaccaggtcaagacagagaccactatccttgatgtggacctcaggccagcctctgcctggacactgtatgcagtcgcgacgacgatcctcacccccatgctccgccacaccatcgaaaatacgtcagccaacttatcactcgccgccatcgccaaccaggctgccgttctgatggggctgggcaaggggtggcccctgcaccggatggacctaggggtgcccctgctcgcgatgggctgctactctcaggtgaacccgaccacactcaccgcctccctggtaatgctccttgtgcactacgcgataatcgggcccggcctgcaagcgaaggccacacgtgaggcccagaaacggactgcggcgggcataatgaagaacccaacagtggacgggatcacagtgatagatctcgaacccatctcatatgacccgaaattcgagaaacagcttggccaggtaatgttactcgtgttatgcgccgggcagctgctcctgatgcgcacgacctgggcattttgcgaggtgctgaccctcgcgactggccctatcctgacgttatgggagggtaaccccggcaggttttggaacacaaccatcgcagtgtccacagctaacatcttccggggctcctacttagccggggcgggcctggccttttccctcatcaagaatgcacagacaccccgacgcggcaccggcacgacaggggagacgctcggtgagaagtggaagagacagctgaacagtctggaccgcaaagagttcgaggaatacaaacgctccggcatcctcgaggtggaccgcacggaggccaagtctgccctgaaggacgggtctaaaattaagcacgccgtctctcggggcagcagcaagatccgatggatagtagagcgggggatggtaaagcctaagggcaaggtcgtcgacctgggttgcggccgcggcgggtggtcctactacatggccacacttaagaacgtaaccgaggtcaagggctatacgaagggtgggcccgggcatgaggagcccatccccatggccacatacgggtggaacttggtgaagctgcatagtggagtggatgtcttctataagcctaccgagcaagtcgatacacttctgtgcgacatcggagagagctcctctaaccccacaatagaggaaggacgcacgctgcgggtgctcaagatggtcgagccatggttaagtagcaagcccgagttctgcatcaaagtgctaaacccgtacatgcccaccgtaatcgaggagctcgagaaactccagcgcaagcatgggggcaacttagtccggtgtcccctgagtcgcaactcaacacacgaaatgtactgggtgtccggcgcgagcgggaatatcgtttccagcgtgaacaccacatccaagatgctcctcaacagatttaccacccgccaccgaaagccgacctacgaaaaggatgtggatctgggcgcagggacgcgctctgtctccaccgaaaccgagaagcctgatatgaccatcatcggccgacgactccagaggctgcaggaagagcacaaggagacatggcactacgaccaggagaacccataccgcacctgggcataccacgggagctatgaggcaccttccaccggcagcgcttctagcatggtaaacggcgtcgtgaagctcctcaccaaaccctgggacgtgattcctatggtgacccaattggcaatgaccgacaccaccccattcggccagcagcgagtgttcaaggagaaggtcgacacaaggacgccccagccgaagccaggtacccggatggtgatgaccacgacagccaactggctgtgggccctcctggggaagaaaaagaacccccgcctctgcacccgcgaggagttcatcagcaaggtccgctccaacgcggcgatcggcgccgtttttcaggaggagcaggggtggacctcagcctccgaggctgtaaatgactcccgcttctgggagttagtggataaggaacgcgcactgcatcaggaaggcaagtgcgagtcgtgcgtgtataacatgatggggaagcgagagaagaagctgggggagttcggacgcgcgaaggggagccgcgccatttggtacatgtggttgggcgcgcggttcctggaattcgaggcccttgggtttctcaacgaggaccactggtttggccgcgagaactcatggagcggcgtagagggggagggactgcatcggttggggtatatcctcgaagagatcgacaaaaaggacggcgacttaatgtacgctgatgatacggcgggatgggacacccgaatcacagaggacgacctgcagaacgaagagcttatcacagaacagatggctccccatcacaagatcctggccaaagcgatcttcaagctgacgtatcaaaacaaggtggtgaaggtgttgaggccgacgccccgcggcgccgtcatggacatcatatcccggaaggaccagcggggaagcggtcaggtgggaacgtacgggttgaacaccttcaccaatatggaggtgcagctgattcggcagatggaggccgagggcgtcatcacccaggacgacatgcagaaccccaaaggcctcaaggagcgagtagagaaatggctgaaggagtgtggggtagaccggctcaagcgaatggccatctccggagacgactgcgtcgtaaagcctctagatgagaggttcggaacgagcctgcttttcctaaatgacatgggcaaggtccggaaagatatcccgcagtgggagccttccaaaggctggaagaactggcaggaggtccccttctgcagccatcacttccataaaatctttatgaaagatggccggtccctcgtggtgccctgccgcaaccaggacgagctgataggccgggcccggatcagccagggggccggttggtccctccgggagaccgcgtgccttggtaaggcctacgcacaaatgtggagcctcatgtacttccaccgcagggacctacgccttgcctcgatggcaatatgttcggcggtcccaaccgaatggttccccacgagccgcactacgtggtcgatccacgcccatcaccaatggatgacgacggaagacatgctgaaggtatggaacagagtttggatcgaggacaatcccaacatgaccgacaaaacccccgtccacagctgggaggacatcccgtacttaggcaagcgcgaagacctgtggtgcggctccctgatcggactctcatcaagagccacctgggcaaaaaacatccacacggccatcacccaggtgagaaatctgatcggtaaggaagagtatgtcgactacatgccggtcatgaagcggtactcagctcctagtgagagcgagggggtgctatag

SEQ ID NO: 26306 - RNA, 9867 nt, synthetic construct
  misc_feature 1..9867: note = derived and/or modified CDS sequence (opt11) from DENV-4__JQ915090__SS-prME
  source 1..9867: mol_type = other RNA
agcactatgaccctcttatgcttaattcccaccgtgatggcattccacttgtccacacgcgacggagagccgctaatgatcgtggccaaacatgagcgggggcgtcccttgctgtttaagaccaccgagggcatcaacaagtgcaccctcatagccatggacctgggggagatgtgcgaggacaccgttacctacaaatgccccttgttggtgaacaccgagcccgaggacattgactgctggtgtaacctgacctcaacctgggtaatgtacgggacctgtacccagtccggggagcggcgccgggaaaaacgcagcgtagccctgaccccgcactcaggcatgggcttggaaactcgtgccgagacctggatgagttccgagggggcctggaagcacgcacaacgagtggagagctggatcctgcggaaccccggattcgcgctgctcgccgggttcatggcctatatgattggccagaccgggatccagcgcattgtcttcttcgtgctgatgatgctggttgccccttcctacggcatgcgttgtgtaggcgtggggaatcgcgacttcgtggagggcgtcagcgggggcgcgtgggtggacctggtgctggaacacggtgggtgcgtcaccacgatggctcagggcaaaccaaccctggacttcgagctcgctaagactacggccaaagaggtggccctgctcagaacctactgcatcgaggcgtccatctcgaacataaccaccgcgacaaggtgcccaacacagggggagccgtacctcaaggaagagcaggaccagcagtacatctgccggcgagacgtcgttgaccggggctgggggaacggctgcggtctgttcgggaaaggaggggttgtgacatgcgccaagttcctgtgctcaggcaagattaccgggaatctagtgcagatcgagaacttagagtacacggtggtggtgaccgtgcacaacggggatacacacgccgtgggcaatgacaccagtaaccacggagtcactgctaccatcaccccccggtcccccagcgtggaggttaaactgccggactacggcgagctcacccttgactgcgagcctcgctccgggatcgacttcaacgaaatgatcctgatgaagatgaagaagaagacgtggctggtacacaagcagtggtttctagatctgcccctcccctggacagcgggcgccgatacttctgaggtccactggaactataaggagagaatggtcacgttcaaggtgccacacgcgaagagacaagatgttaccgttctgggatcccaggagggcgcgatgcacagcgccctggcaggagccacagaagtggacagcggggacggaaaccacatgtttgctggccacctcaagtgcaaagtgcggatggagaagctgaggattaagggaatgtcctacacgatgtgcagcggtaagttcagtatcgacaaagagatggccgagacccagcacgggaccacggtcgtgaaggtgaaatatgagggcgctggggctccctgtaagatacctatcgaaatacgggacgtgaacaaggagaaggtggtgggccgtatcatcagctctacccccttcgccgagaacaccaatagtgtcattaacatcgaactggagccgcccttcggggacagttacatcgtgattggcgttggagactcggccctcactctgcattggttccgaaagggatccagcatcggcaaaatgttcgagtccacgtaccgcggggccaagcggatggcgattctcggcgagaccgcatgggacttcggtagcgtcggcgggctcttcacttccctcggaaaggccgtgcatcaggtgttcggcagcgtctacaccactatgttcggaggcgtgtcctggatgatcagaatcctaatcgggttcctcgtgctgtggataggcaccaacagtagaaacacctcgatggccatgacgtgcatagctgttggcgggatcacactctttctaggctttacagtccaggcggacatggggtgcgttgtaagttggaatggcaaggagttgaagtgtgggtctggcatctttgtagttgacaatgtacacacctggaccgagcagtataagttccagcccgagagcccagcacgcctagcgtcggccatcctgaacgcccataaggacggcgtttgcggtatccggtccaccacgcgcctcgagaacgtgatgtggaagcagatcaccaacgagttgaattacgttctgtgggagggcgggcacgacctcactgtggtggctggggacgtcaaaggcgtcctgacgaaaggaaagcgggccctgaccccacctgtgaacgacctaaagtacagttggaaaacctggggtaaggccaaaatcttcaccccggaggcccgcaactccacgttcctgatcgacgggccggacaccagtgagtgcccaaacgaacggcgcgcctggaatttcttcgaggtagaggattacggcttcgggatgttcaccaccaacatctggatgaaattcagagagggctcctcagaggtgtgtgaccatagactgatgagcgccgccatcaaggaccaaaaggccgtgcacgccgacatggggtactggatcgagagctccaagaaccagacgtggcaaatagagaaggcgtcactaatcgaggtgaagacatgcctctggcctaagacacacaccctgtggtcgaacggcgtgctcgagagtcagatgctgattccccgatcctatgcagggccgttcagccagcacaactaccgccagggatatgccacacaaacagccggcccatggcatctgggtaaactcgagatcgacttcggcgaatgccccggcaccactgtgaagatccaggaagactgtgaccatagggggccgtcgctgcgcacaacaactgccagcggcaagcttgtcacccaatggtgctgccgctcctgtactatgccaccgctccggttcctgggggaggacggttgttggtacgggatggagatccggccactgagcgaaaaggaagaaaacatggtgaagtcccaggtgacggcgggccaaggcaccagtgagacattctctatgggtctcctgtgccttaccctcttcgtcgaagagtgcctgcggaggcgggtgactcgcaagcacatgatcctggtcgtggtgatcaccttctgcgccatcatccttggcgggctgacctggatggacttgctccgggctctgattatgctcggcgacacaatgtcaggtcgaataggtggtcagatccatctcgcaatcatgacggtcttcaagatgagcccggggtacgttctaggcgtcttcctgaggaagctcacctcccgggagaccgccctgatggtcatcgggatggcgatgactacagtcttcagcatcccgcacgacctgatggagttgatcgacgggatttccctgggcctcatcttactgaagatcgtgacccacttcgataacacccaggttgggaccctggccttgagccttacgttcatgcggagtaccaccccattggttatggcgtggcggacgatcatggccgtgttcttcgtgataactctcatccccctgtgccggaccagctgcctgcagaaacagtcccactgggtggagatgaccgccctgatcctaggcgcgcaggctctgccggtgtacctcatgactctgatgaagggggccagtcgccggtcctggccgctgaacgaggggatcatggctgtcggactcgtgagcctgctgggatctgcgctcttaaagaacgacgtgcctctagccggccccatggttgccgggggcctcctgctggccgcctacgtaatgagcgggagctcagcggacttatctctggaaaaggccgccaacgtgcagtgggacgagatggctgatatcacgggaagcagccccattatcgaagtcaagcaagacgaggacgggtccttctcaatccgggacgtggaggaaaccaacatgatcacacttttggtgaagctcgccctcatcacggtctccggcctctatccgctggcgattcccgtgacgatggccctttggtacatctggcaggtgaaaacccagcggtccggagccctctgggatgtcccctcccccgccgctactcaaaaggcgaccctgagcgagggggtgtaccgcatcatgcagagaggattgtttgggaagacccaggtgggcgttgggattcacatggaaggcgttttccacaccatgtggcacgttacccgtggctctgtcatctgccacgagaccgggcggctcgagccgagctgggccgatgtgcgctcagacatgataagctacggcgggggatggcgcctgggtgacaaatgggataaggaagaggacgtacaggtcctggccatcgagcccggtaagaacccccgccacgtgcagaccaagcccggtctcttcaagacgctgaccggggagatcggcgccgtcaccttggacttcaagccgggaacttccggcagccccataattaacaagaagggtaaggtcatcgggctctatggcaacggggtcgtcaccaagtccggcgactacgtcagcgccatcacgcaggctgagcgtataggtgaacccgattacgaggtggatgaggacatcttccgcaagaagaggttaaccatcatggacctgcacccgggtgccggcaagaccaagcggatcctccccagcattgtgagggaagctctgaagcggcgactccggacgctcattctggcgccaacacgcgtagttgctgcagaaatggaggaggcccttagggggctgcccatccggtaccagacaccggcggttaagtctgagcatacaggaagagagattgtcgacctcatgtgccacgccacgttcaccacgcgccttctctcatcaactcgcgtgcccaactacaacctcatcgtgatggacgaggcgcacttcacggatccctgctcggtcgccgccagagggtacatcagcacacgagtggagatgggcgaggctgccgcgatcttcatgaccgccacgccgcctggctcgatcgatcccttcccccagtccaacagccccatcgaggacatagaacgcgagattccggaacggagttggaatacgggattcgactggatcactgactaccaaggcaagaccgtctggttcgtgccctcaattaaggcggggaacgatatcgccaactgccttaggaagagcggcaagcgcgtgatccagctgagccggaaaactttcgacacggagtaccctaagaccaagttgaccgactgggactttgtggtgacgacggacatctccgaaatgggggccaacttccgcgctggcagagtgattgaccccaggcggtgtctgaagccggtaatcttgaccgacgggcccgagcgcgtgattctcgccggtcccatacccgtgacccctgccagcgccgcgcagcggcgcggtcgcatcggtcgcaatccagcccaggaggacgatcaatacgtcttctcgggggaccccttaaagaacgacgaagatcacgcccactggaccgaggctaagatgctgctcgacaatatctacactcccgaggggatcatcccgacccttttcggccccgagcgtgagaagacccaggccatcgacggcgagttccgcctgaggggtgaacaacgcaagactttcgtggagcttatgcggcgcggtgacctgcccgtgtggctctcttataaggtcgcgtccgccggtatcagctacaaggacagggagtggtgctttaccggtgaacggaacaatcaaatcctcgaggaaaacatggaagtagagatatggactagggagggggagaagaagaagttgcgacccaagtggctggacgcacgggtttacgccgacccgatggccttgaaggactttaaagaattcgcgagtggccggaagagcaccactctggacatcctgacagagatagcaaccctccctacctatttgtccagcaaggctaaattagctttagacaacattgtgatgctacacaccaccgagaagggcggtcgcgcctaccagcatgcgttgaatgagctccccgaatccctggagacgctgatgctcgtggccctgctgggcgccatgacggcggggatcttcctgtttttcatgcaaggcaagggaattggcaagctcagcatgggcctgatcgcgatcgccgtagcttctggattactgtgggtcgccgagatccagccgcagtggatagccgcgagcatcatcctcgagttctttctcatggtgctgctcatccccgagcccgagaagcagcgcacgccccaggacaaccagctaatatacgtcatcttgaccattctaacaatcatcggcctgatagccgccaacgagatggggcttatcgagaagacgaagacggacttcggcttctatcaggtcaagacggagactaccatactagacgtggacctccgcccggcctcagcttggactctgtacgcagtagccacgacgatcctgacccctatgctccggcacaccatcgagaacatgtccgccaacctgagcctggccgccattgcaaaccaagccgccgttcttatggggctgggcaagggttggcccttgcaccgtatggatctaggtgtcccactgctggccatggggtgctattcccaagtgaacccgaccacgctcaccgccagcttagtcatgcttttaatccactacgccatcatcgggcccggcctgcaagcaaaggccacccgggaggcacagaagagaactgcggccggaattatgaaaaaccccaccgtggacgggatcacggtgatcgatctggagcccatctcctacgacccgaagttcgagaaacagctcggccaggtcatgctactggtcctatgcgtggggcaactattactcatgcggaccacctgggccctttgcgaggtgcttacgttagctaccggccccataatgaccttgtgggaggggaatcccggccggttctggaacaccacgatcgccgtgagtaccgctaacatctttagaggctcttacctcgctggtgcaggcttggcatttagccttatcaagaacgcccaaacgccccgccgggggacgggcacaaccggcgaaaccctgggcgagaagtggaagcgccagcttaactccctggaccggaaagaatttgaagaatataaacgaagcggcatcctggaggtggacagaaccgaagcgaaatccgctctccgcgacggcagcaagatcaagcacgccgtcagtcgtggcagctccaagatccgttggatagtcgagcgggggatgatcaagcctaagggcaaggtggtcgacctcggctgtggcaggggcggttggagctactacatggccacgctgaagaacgtgaccgaggtgaagggctacaccaaaggcggccccgggcacgaggaaccaatcccaatggctacctatggctggaacctcgtaaagctgcattccggcgtggacgtgttctataagcctaccgagcaggttgacacgctgctctgcgacatcggggagagctccagcaaccccaccatcgaggagggacgcacgttacggatcctaaagatggtggagccttggctcagctctaagccagagttctgcatcaaggttctcaacccgtacatgcccaccgtcattgaggagctggagaagctccagcgccggcacgggggcagcctggtgcgctgccccttgtccagaaacagtacgcacgaaatgtactgggtatccggcgcaagcgggaacattgtctccagcgtaaacaccatctccaagatgctgcttaaccgcttcactacccggcacaggaaacctacgtacgagaaggacgtggacctgggcgcggggacccggagcgtgtccacagagaccgagaagcccgacatgacgatcataggccggagactgcagagactccaggaggagcacaaagagacctggcactacgaccaggagaacccctaccggacctgggcctatcacgggagctacgaagccccctccaccggctcggcgtccagcatggtgaacggcgtcgtgaagctgctgacgaagccgtgggacgtgatccccatggtcacccagttagcgatgaccgacaccacgcccttcggtcagcagcgcgtgttcaaagagaaagttgacacccggacaccccagcccaaactgggcacccgcatgattatgacgacgaccgccaactggctgtgggcccttctcgggaagaagaagtcccctagactgtgcacccgcgaggagttcatcagcaaggtccggagcaacgccgcgattggtgcagtgttccaggaggagcaggggtggacatccgcgatcgaagccgtaaacgacagccggttctgggagctcgtggacaaggaacgggccctgcaccaggagggcaagtgcgagtcctgcgtgtacaatatgatgggtaagcgcgagaagaagttgggtgagttcggccgcgcgaaggggtcgcgggccatctggtacatgtggctcggcgccaggttcctggagttcgaagctttagggttcctgaacgaggaccattggttctcacgggagaacagctggagcggcgtcgagggcgaagggctacatcgcttaggctacatcctcgaagatattgacaagaaggacggggacctgatctacgcggacgacacagcgggttgggacactcgcatcactgaggatgacttgctcaacgaggagctgatcacggaacagatggccccgcaccataagaccctggccaaagccatcttcaaactcacgtaccagaacaaggtggtgaaggtcctgagacctactcccaagggcgcggtcatggacatcatatccaggaaggaccagcgcggctccggtcaggtgggtacgtacggcctgaacacattcaccaacatggaagtccaactaatccgccagatggaggccgagggagtcatcacacaggacgacatgcaaaaccccaagggcctcaaggagagagtggagaagtggctgaaggaatgtggcgttgaccgtctcaagcgcatggcgatctcaggggacgactgtgtcgtgaagccccttgacgagcggttttccaccagcctgctgttcctgaatgacatgggcaaggtgcgcaaggacgtcccgcagtgggagccatccaaggggtggaagaactggcaagaggtccccttctgcagccaccacttccataagatttttatgaaagacggcagatccctggtggtcccatgccgcaaccaggacgagctaatcgggcgggcgcggatcagccagggcgctggctggtccctgcgagaaacggcatgcctggggaaggcctatgcccagatgtggagcctcatgtactttcaccgccgagacctccggctggcctccatggccatctgtagcgcggtgcctaccgagtggttcccgaccagccggacaacgtggtccatccacgcccaacatcaatggatgaccaccgaggacatgctcaaggtttggaatcgggtatggattgaggacaaccctaacatgaccgataagacgcccgttcacagctgggaggacattccttatctgggcaagcgcgaggacctgtggtgcgggtcgttgataggcctgagtagcagagccacttgggccaagaacatccacactgctattacccaggtgcgcaacctgatcgggaaggaagaatatgtcgactacatgccggtgatgaagcgttatagctcccctagcgagtccgagggcgtgctctga

SEQ ID NO: 26307 - RNA, 9867 nt, synthetic construct
  misc_feature 1..9867: note = derived and/or modified CDS sequence (opt11) from DENV-4__KJ160504__SS-prME
  source 1..9867: mol_type = other RNA
tctaccatcacattactctgcctgattcccactgtgatggcattccacctgtccactcgtgatggcgagccgctcatgatagtggctaagcacgaacgggggcgaccccttttattcaagacgaccgaaggcatcaataaatgtacgctcatagccatggacttaggggagatgtgtgaggacaccgtcacttacaagtgtcccttactggttaacactgaacccgaggacatcgactgctggtgcaacttgacaagcacctgggtgatgtacgggacctgcacccagtccggcgagagaaggcgggagaagcgcagcgttgccctcacgccccatagcggcatgggcctcgagacccgggccgagacgtggatgagcagtgagggggcctggaagcacgcccagagagtggagagctggatacttcgcaatcccgggttcgcgctgctagccgggttcatggcctacatgatcgggcaaaccgggattcagcgcacagtcttcttcgtgctgatgatgctggtggcgccctcctacgggatgcgttgcgtcggcgtagggaaccgcgacttcgtagagggcgtcagcgggggcgcgtgggtggacctcgtgttggagcatggcgggtgcgtcactaccatggcccagggaaagcctaccctggactttgagctcactaaaacgacagcgaaggaggttgccctgcttcggacctattgcattgaggcctctatctctaacatcacgaccgctacccggtgcccgacccagggggagccctacctcaaagaggagcaggaccaacagtacatttgccgtcgcgacgtggtcgaccgagggtgggggaacggctgcggtctgttcgggaagggcggggtggtgacgtgcgccaagttctcctgctctggtaagataaccggaaacttggtccagattgagaacctcgaatacaccgtggtagtgaccgtgcacaacggggacacgcacgcagtcggtaatgatacatccaaccatggggtgaccgccactatcacgcccagaagcccctccgtggaggttaaattgcccgactacggtgagctaacgttggattgcgaaccccggagtggaatagatttcaacgagatgatcctaatgaagatgaaaaagaagacctggctagtgcataagcagtggttcctcgacctgcctctgccttggactgccggggcggacacaagcgaggtgcactggaactacaaggaacgcatggtcacttttaaggtgccacacgcaaagaggcaggacgtgaccgttctcgggagccaggagggcgccatgcacagcgcactggccggagcgaccgaggtggactccggggacggcaatcacatgttcgcggggcaccttaaatgtaaggtgcgcatggaaaagctgcgcataaagggcatgagctacacgatgtgctccggcaagttcagcatcgacaaggagatggccgagacccagcatgggacaacggtcgtaaaggtgaagtacgagggcgccggagcgccctgtaaagtccccatcgagatccgggatgtaaacaaggagaaggtagtcgggcgcgtcatcagctccaccccccttgcggagaacacgaactctgtgactaacatcgagctggagccacccttcggcgacagctacatcgtcatcggcgtaggcaactccgccttaaccctgcactggttccggaaggggagctccatcggcaagatgttcgaaagcacttacaggggggccaaaaggatggccatcttgggagagacggcctgggactttggctccgtgggcggcctcttcacgagcttaggaaaggcagttcaccaagttttcgggtcggtctacaccaccatgttcggtggcgtctcgtggatgatcagaatcctgatcgggttcctcgtgctgtggatcgggacgaactcccggaatacctcaatggccatgacctgcatcgctgtgggagggattacactgtttctggggttcacggtccaggcagacatgggatgtgtggtgtcctggtctgggcgggagttaaagtgcgggagcgggattttcgtcgtggacaacgtgcatacctggaccgagcagtacaagttccagcccgagtcccccgcgcgactggccagcgccattctgaacgcccacaaggacggcgtctgcgggatacgttccaccaccagattagaaaacgtgatgtggaagcagatcaccaatgagctgaactacgtcctgtgggagggtgggcacgacttgaccgtggtggccggtgacgtgaagggggtcttaaccaaggggaagcgcgctctgacgccgcccgtcagcgacctgaagtatagttggaagacgtggggcaaggcaaagattttcacccccgaggcccgaaacagcaccttcctcatagacgggcccgacacgtccgagtgcccgaacgagcgacgggcatggaacagcctagaagttgaagattacggctttgggatgttcaccaccaatatctggatgaagttccgagaaggcagcagtgaggtctgcgatcaccgcttaatgtccgccgcgatcaaggatcaaaaggcggtacacgccgacatgggctactggatcgagagttctaagaaccagacgtggcaaatcgagaaggcatcgctgatagaggtgaaaacgtgtctatggcccaaaacgcataccctttggtccaatggggtactggagagccagatgttgattccaaagtcctacgcagggccgttcagccagcataactaccgccaaggatacgccactcaaaccgtaggcccctggcacttgggcaaactagaaatcgacttcggcgaatgccccggcacgacggtgacaatacaggaggactgcgaccaccgagggcccagcttgcgcaccacgactgccagcggcaaactcgtcacccaatggtgctgcagatcttgcaccatgccgcccttgcggttcttaggggaagacggctgctggtacggtatggagatccgccccctgtctgaaaaagaggagaatatggtcaagagccaagtcaccgcgggccagggcacgtccgaaactttttccatgggcctgttatgtctcaccctgttcgtggaggagtgtctgagacgcagagttacgcgtaagcacatgatcctcgtcgtggtgattacgctgtgcgctataatactgggcggactaacctggatggacctgctgcgagcgttaattatgttgggcgacaccatgagcggccgcatcggtggacagatacacctggccatcatggccgtcttcaagatgagccccgggtacgtactcggcgtgtttctgcggaaactgacgtcccgcgagacagcccttatggtaatcggcatggccatgaccacggtgctgagcatcccgcacgacctgatggagttgatcgatggcatctccctgggcctgatcctgctgaaaatcgttacgcagttcgataacacccaggtcgggaccctcgcgctcagcctgactttcatacggtccactatgcccttagtgatggcctggcgcaccataatggccgtattattcgtcgtgacattgatcccgctctgccggacgtcctgtctccagaagcagtcccactgggttgaaatcacggccctaatcctgggcgcccaggcgctccctgtatacctgatgaccctcatgaagggggctagcagacggagttggccactcaacgagggcatcatggccgttggcctagtaagtttactcggctccgcactgctgaaaaacgatgtccccctcgcaggccccatggtggccggcggcctgcttctcgccgcctacgtaatgagtggcagctcggccgacctgagcctggagaaagccgccaatgtgcagtgggacgagatggccgacatcacaggatccagtcccatcatcgaagtgaagcaggacgaggacgggtccttcagcatccgtgatgtggaggagactaacatgataacgctcttggtgaagttggccctcatcactgtgtcaggtctgtaccccctggccatccccatcacaatgaccctttggtacatgtggcaggtgaagacacagcggagcggcgcattgtgggatgttccttcccctgccgccacccagaaagccgccctttcagagggggtgtaccgaataatgcagagaggcctcttcgggaaaacccaagtgggcgtcggaatacacatggagggcgtattccacacaatgtggcacgtaacccgcggctccgtcatttgccacgagacggggcggctcgagccgtcttgggcggacgtgcgaaacgacatgatctcctacggagggggctggcgcttgggagacaagtgggacaaagaagaggacgtgcaggtgcttgctattgagcccgggaagaatccgaagcacgttcaaactaagcccggcctttttaagaccctgactggagagataggagccgtgactctagacttcaagccgggtacctcgggcagccccatcatcaaccgcaagggtaaggttatcgggctgtacggcaacggagtggtgaccaagagcggcgattatgtgtctgccatcacgcaggcggagcgcattggggagcccgattatgaggtggacgaggacatcttccggaaaaagcgcctaacgataatggacctccacccgggcgccggcaagactaagcggatcctgccaagtatcgtgcgcgaggccctgaagaggcgtttgcggacactcatcctggcacccacccgcgtcgtggccgcggagatggaggaggccctgagggggttacccatccgctaccagacgccggcggtgaagtcagagcatacaggccgcgagatcgtcgacctgatgtgtcatgccaccttcaccacgcgcctgctctcctcgacgcgggtacccaactacaatcttatcgtcatggacgaggcccacttcacagacccctccagcgtagcggcacgcgggtacatatccactagagtggagatgggagaggccgctgcgatctttatgaccgcgacacccccgggcgccaccgatccctttccccagtctaactcccccattgaagacatcgaacgcgagataccggaacggagctggaacaccggattcgactggattaccgactaccagggcaagacagtctggttcgtgccctccattaaggccgggaacgacatcgccaactgcctgcgaaagagcggaaagaaagtgatacagctcagccgcaagactttcgggacggaatatccaaagacgaagctgaccgactgggacttcgtcgttaccacagacattagcgagatgggcgccaacttccgggcaggacgtgtgatagacccccggcgctgcttaaagcccgtcatcctgacggacggcccagagcgggtgatcctggcaggcccgatccccgtgaccccagcctccgccgcgcagcgcagagggcgcgtcggccgaaaccctgctcaggaggacgatcagtatgtcttcagcggggaccccctgaagaacgacgaagaccatgcccactggaccgaagccaaaatgctccttgacaacatatacacgcccgagggtatcatcccgacgcttttcggccccgagcgcgaaaagacccaggccatcgatggagagtttcgtctccgcggagagcagcggaagaccttcgtggagttaatgcgccggggagatttgcccgtatggctctcctacaaggtagcgagcgccggaatatcctacaaggaccgcgagtggtgcttcaccggcgagcggaataatcagatcttagaggagaacatggaggtggagatctggacgagagaaggtgagaagaagaagctgcggcctcgctggcttgatgccagagtttacgctgacccgatggccctaaaggacttcaaggagttcgcgagcggtcgcaagagcataaccctggatatcctcaccgagattgcgtcactgcctgcctacctgtccagtcgcgccaagctcgcgctggacaacatcgtgatgctgcacaccaccgaacgggggggccgcgcgtaccagcacgccctcaacgagttgcccgagagcctggagacgctcatgctggtggccctactcggtgcaatgaccgcgggcatcttcctgttcttcatgcagggtaagggtatcggcaagctgtcgatggggctcataaccatcgccgtcgccagcggattattatggatcgcagagatccagccgcagtggatcgccgctagcatcatcctcgagttctttctgatggtgctgctcatccccgaacctgagaagcagcggaccccccaggataaccagctcatctacgtgatcctaacggtgctcaccattatcgggctgattgccgccaatgaaatgggcctgatagaaaagaccaagaccgacttcgggttttatcaggtgaagacggagaccactattttagacgttgacctgcgacctgcgtccgcctggaccctgtacgcagttgccacgacggtactcacccccatgctgagacacaccatagagaacacatcagccaacctgagccttgcagctatcgcgaatcaagctgccgtgctgatgggcctgggcaagggttggccccttcaccgcatggacctgggcgtccccctgctcgcgatgggatgttattcccaggtaaatcctaccacgctgaccgcttcactggtgatgctcttcgtccactatgccattatcggacccggcctgcaggccaaagccacgagagaagctcagaagcgcactgcagccgggatcatgaagaaccccacagtggatggtatcactgtgatcgacctggagcctatttcctacgacccgaagtttgagaaacagctcggccaagtcatgctgcttgtcctctgcgctggccagctgctgctcatgcggacgacctgggccttttgcgaggtgctgacgctggcaacagggcccatattgactctgtgggaaggcaaccccggacgtttctggaacaccaccatcgcggtctccaccgccaacatctttagagggtcatatctggcgggcgcagggttggcctttagcttgatcaaaaatgcgcagacgcctcgcaggggcaccggcaccacaggcgagacgcttggagaaaagtggaagcgccagttgaactccctggaccggaaggagtttgaggaatacaagcgcagcgggatcctagaggttgacaggaccgaagctaagtccgccctcaaagatggcagcaagatcaagcacgccgtgagtcgcgggagctcaaagattagatggatagtcgagaggggaatggtgaagccgaaggggaaggtcgtcgacctgggctgcggaagggggggctggagctactacatggccaccctcaagaatgtgacggaggtaaaggggtatacaaagggagggcccggtcacgaggagcccatacccatggcgacgtacggctggaacctcgtcaagcttcattcgggggtggatgtcttctacaagccgacggagcaggtcgacacacttctctgcgatatcggcgagtcctcgtccaaccccaccatcgaggaggggcgaacactacgcgtgctgaagatggtcgaaccatggttgtcctccaagcccgagttctgcatcaaggttctgaacccgtacatgccgaccgtcatcgaagagctggaaaagctgcagcggaagcatggtgggaaccttgtcaggtgccccctgtctcgaaactctacacatgagatgtactgggtgagcggtgcctcgggcaatatcgtgagttccgtcaacacaaccagcaagatgctgctcaaccgatttacgacacggcaccgtaagcccacctatgagaaggacgtggatttaggggccggcactcggtccgtgtcgaccgaaaccgagaagccggacatgaccatcatcgggcgccggctgcagcgcctccaggaggaacacaaagagacgtggcactacgatcaggaaaacccataccgtacctgggcttaccatggctcttatgaagcaccaagcaccggctccgcctcttctatggtaaacggtgtggtgaagctgctgaccaagccgtgggatgtcatacccatggtgacgcagctcgctatgaccgatacaaccccatttggccagcagcgcgtattcaaggagaaggtcgatacacggacgcctcagccgaagcccgggacccgcatggtgatgaccacgacagccaactggctgtgggctctgttgggcaagaagaagaacccacgcctgtgtacccgggaagagtttatcagcaaagtgcgcagcaacgcagcgataggggccgtcttccaagaggagcagggctggacaagtgcttcggaagctgtgaacgactcacgcttctgggaattagtggacaaagagagggcgctccatcaggaaggtaagtgcgagtcttgtgtttataacatgatgggaaagcgcgagaagaaattaggcgagttcggacgcgcgaagggcagccgggcgatctggtacatgtggctgggggccagatttctagagttcgaagccctgggtttccttaatgaagaccattggttcggtcgggagaactcttggtccggggtcgagggtgaggggctccacagacttggctatattctggaggagatcgataaaaaggatggggacctcatgtacgcggacgacacagcagggtgggacacacggatcaccgaggacgacctgcagaatgaggagttgatcaccgagcagatggccccccaccacaagattctcgccaaagcgatattcaagctgacgtaccagaataaggttgtcaaggtgttgaggccgaccccccgaggggccgtcatggacatcattagtcgcaaagaccagcgggggtccggccaggtagggacgtacgggctcaatacctttacgaacatggaagtgcagctaatccggcagatggaggccgagggcgtgatcacacaggatgacatgcagaaccctaaggggctgaaggaaagagttgaaaagtggctccgcgagtgtggcgtggatcggctcaaacgcatggccatcagcggtgacgattgcgtggtgaaaccgctcgacgagcggttcggtacctccctcctgtttttgaacgacatggggaaggtgcgaaaggatatcccccagtgggagccctctaaaggctggaagaactggcaggaggtccctttctgctcccatcacttccacaagatcttcatgaaggacgggcggtcattggtggtgccctgccgcaaccaggacgagctgatcgggcgggcccgcatctcccagggcgcagggtggagtctgcgcgagacggcatgcttgggcaaggcatatgcgcagatgtggtccttgatgtactttcaccggcgcgatctacggctagcctccatggcgatctgctcggcagtgccgactgagtggttccccacctcccgcacgacctggtcaatacatgcccaccaccagtggatgaccacggaggatatgctaaaggtctggaacagagtgtggatagaagacaatcccaacatgacagacaagactcctgtgcacagttgggaggatatcccctacctggggaaacgagaggacctctggtgtggcagccttatcggcctgtcctcacgggccacgtgggctaaaaatattcacacggctatcacccaagtccgcaacctcatcgggaaggaggaatatgtggactacatgcccgtgatgaaacggtattcagcccctagcgagtccgagggcgtattgtga

SEQ ID NO: 26308 - RNA, 9867 nt, synthetic construct
  misc_feature 1..9867: note = derived and/or modified CDS sequence (opt11) from DENV-4__GU289913__SS-prME
  source 1..9867: mol_type = other RNA
agcaccatcaccctgctgtgtctgattcccaccgtaatggccttccacctgtccacgcgggacggggagcccctcatgatagtggccaagcacgagcgggggcgcccccttctgttcaagaccacagaaggcatcaacaagtgcaccttgatcgcgatggacctgggggagatgtgtgaggacaccgtgacctacaaatgccccctgcttgtgaataccgagcccgaagacatcgactgctggtgcaacctgaccagcacgtgggtcatgtacgggacctgtacccagtccggcgagcgtcgccgggagaagaggtctgtggcactgaccccgcactccggaatgggcctcgagacccgtgccgaaacctggatgagctccgagggggcgtggaagcacgcccagcgcgtcgagtcttggatcctgcggaaccccggctttgcgctgctcgccggtttcatggcctacatgatcggccagaccgggatccaaaggacggtgttcttcgtgctgatgatgttggttgctccctcctacgggatgcggtgcgtcggcgttggcaatcgcgatttcgtggagggagtcagcgggggcgcgtgggtggaccttgtgctggagcacggcgggtgcgtcaccaccatggcgcaaggaaagcccaccctggatttcgaactcacgaagaccacggccaaggaggttgcgctgctccggacgtactgcattgaggcgtccatctccaacataacgactgcgacgcgttgcccaacccaaggggagccctacttgaaagaggagcaggaccagcagtacatttgccggcgtgacgtggtcgaccggggctgggggaacggctgcggcctcttcggaaagggaggagtggtcacgtgcgcaaagttctcctgtagtggcaagatcacggggaacttagtccagatcgaaaacctcgaatacacagtagtggtcaccgtgcacaacggcgacacacacgccgtaggcaacgacacgtcaaaccacggggtgaccgccatgatcacgccaagaagcccttccgtggaggtcaagctgccggactacggcgaactgacgctcgactgcgagccccggtccgggattgacttcaacgaaatgatcctgatgaagatgaagaagaaaacatggcttgtacacaagcaatggttccttgacctgcccttgccctggactgccggcgcggacacatccgaggtgcactggaactataaagaacgtatggtaacttttaaagtcccacatgctaaacggcaggacgtgacagtcttagggagtcaggagggtgccatgcacagcgcgcttgctggcgccaccgaggtggattcgggtgacggcaaccacatgttcgcgggacatctgaagtgcaaggtaaggatggagaagttacgcatcaagggcatgagctacaccatgtgctctggcaagttctcgatcgataaagagatggccgaaacccagcatgggacgaccgtcgtgaaagtgaagtacgagggggccggggccccatgcaaggttcccatcgaaatcagagacgtgaacaaggagaaggtggtgggccgcatcatctcctcaacgcccctggctgagaacactaattccgtgacaaacatcgagctggagccgcctttcggggatagttatattgtgatcggcgtgggcaactccgccctcaccctgcactggttccggaaggggagctccatcggcaagatgttcgagagcacctatcgcggggccaagcggatggcgatcctgggcgagacggcgtgggacttcgggtcggtgggcggcttatttacgagcttgggcaaagcagtccatcaagttttcggcagtgtgtacactaccatgttcggaggcgtgagttggatgatccgcatcctgatcgggttcttagtcctgtggatcggtacaaactcgcggaacacgagcatggcaatgacctgcatcgctgtgggcgggattaccctgttcctaggcttcactgtgcaagccgacatggggtgcgtcgtgtcctggagtggcaaggaactcaagtgcgggagcggcatattcgtcgtcgacaacgttcacacgtggaccgagcaatataagttccagcccgaatcccccgcgcgcctggccagcgccatcttgaacgcccacaaagacggcgtgtgcgggattcggtccaccaccaggctcgaaaacgtcatgtggaagcagatcactaacgagctgaactatgttctgtgggaaggtgggcatgacctcacagtagtcgcgggcgacgtgaaaggcgtgctgaccaagggcaagcgagcgctgaccccgcccgtcagcgacctcaaatactcctggaagacctggggcaaggccaagattttcacccccgaggcgagaaactctaccttcttgatcgacgggcctgacacaagcgagtgcccgaacgagcggcgcgcatggaacagcctggaagtggaggactacggcttcgggatgttcacgaccaacatctggatgaagtttcgggagggcagttctgaagtttgcgaccaccgcctcatgtccgcagcgatcaaggaccagaaggcggtccacgccgacatgggttactggatcgaaagcagcaagaaccagacctggcaaatcgaaaaggccagcctgatagaggtgaaaacctgtctgtggcccaagacgcacaccctctggtccaacggggtgctggagtcgcaaatgctgattcccaagtcctacgcgggcccgtttagccagcacaattaccgccaagggtacgctacccagaccgtcggcccctggcacctcgggaagttggaaatcgactttggcgagtgccctggcaccacggtgaccatccaggaggattgcgaccaccgcgggccctcacttcggacaactaccgcctccggcaagcttgtgacccagtggtgctgccggagttgcacaatgccgccattgaggttcctgggggaggacggctgttggtacgggatggaaatcagacctttatccgagaaagaggagaacatggtcaaatcacaggttaccgccggccagggcacgtccgaaaccttcagcatggggttgttgtgcctcaccctgttcgtcgaggaatgcctgcgccggcgcgtgacacgaaagcacatgatcctggtggtcgtgatcactctgtgcgcaatcatcctgggcgggctcacttggatggacctgctccgcgcgctcatcatgctgggcgacacgatgtccggccggatcggtggccaaatccacctggccatcatggcagtcttcaaaatgagccccgggtatgtcctcggcgtgttcttacgcaaactgacgtcccgtgagacagcccttatggtgatcgggatggcgatgaccaccgtcctgagcataccgcacgacctgatggagctcatcgacggcatctccctgggcctgatcctccttaagatcgtgacccaatttgacaacacccaggtggggaccctcgcgctcagcctgacgttcatccgctccaccatgcccctggtcatggcctggcggacgatcatggccgtcctctttgttgtcacgctgatccccctatgccgcaccagctgcctccagaagcagtcccactgggtggagattaccgccctgatactcggcgctcaagcgctacccgtgtatctgatgacgctgatgaaaggggcaagccgtcgctcctggccgcttaacgagggcatcatggcagtcgggctggtgagcctgctcgggagcgccctcctaaagaatgacgtacccctggcgggcccaatggtcgccgggggcctgctgctagctgcctacgtgatgagcggtagctcagccgacttaagcctggagaaggcggctaatgtgcagtgggacgagatggccgatataacaggctccagcccgatcatcgaggtgaagcaagacgaagacgggtccttctccatccgggacgtggaagaaacgaacatgatcacgctcctggtaaagctggcactcattacagtctcaggcctgtacccgctagccatccccgtcaccatgaccttatggtatatgtggcaggtcaagactcagagaagcggcgcgctttgggacgtcccctcaccagctgctacccagaaggccgccctgtcagagggggtgtataggattatgcaaagaggccttttcgggaagacccaggtgggcgtcgggatccacatggagggcgtgttccatacaatgtggcacgtgacccgcggctcggtcatctgccacgagaccgggcgcttagagcctagctgggccgacgtgcggaacgacatgatctcctacggcggggggtggcggctgggcgacaagtgggacaaggaggaggacgttcaggtactcgccattgagcctgggaagaaccccaaacacgtgcagacgaagcccggcctgttcaagactctgaccggagagatcggcgccgtaaccttagacttcaaaccggggacgagcggaagcccgatcatcaatcgcaagggcaaggtgatagggctgtacggcaacggggtggtgactaagagcggcgactacgtctccgccatcacccaggctgagcgaataggggagcccgactacgaagtagacgaggacattttcagaaagaagcggctaaccatcatggatctccacccgggcgcgggcaagacgaaacgcatcctcccaagcatcgtgcgggaggccctcaagcgccggctgcgcaccctaatcctggcccccactcgggttgttgccgcggagatggaggaagccctccgtgggctccccatccggtaccagaccccggccgttaagtccgagcacacgggtagagagatcgtcgacctcatgtgccatgccaccttcaccaccaggctgctcagctcgacgcgtgtgcccaactacaatctgattgtcatggatgaggcccattttaccgacccctccagcgtggcggcccgagggtatatctccacaagagtggagatgggcgaggccgccgccatttttatgaccgcgacgcccccgggggcaaccgatcccttcccccagagtaactcaccaatcgaggacatcgaacgggagatcccggagcgcagctggaacaccggcttcgactggataaccgactaccagggcaagacggtctggttcgtgccctcgatcaaggccgggaacgacatcgccaactgcctgcgcaagagcggcaaaaaggtgatccagctcagtaggaagaccttcgacaccgagtatccgaagaccaagttgaccgactgggacttcgtcgtgaccaccgatatcagcgagatgggggccaatttccgcgccggccgggtgatcgacccccgccggtgcctgaagccagtcatcttgaccgacggccctgagcgcgtcatcctggcaggccccatccccgtgacgccggcctccgccgcgcagcggcgcgggagaatcgggcgcaatcctgcccaggaggacgatcagtacgtcttcagcggcgaccccctcaagaacgacgaggaccacgcccactggaccgaggccaaaatgctcctggacaatatctacacacccgaggggatcattccgacgctattcggccctgagcgggagaagacgcaggccatcgacggagagttccgcctcaggggggagcagcgcaagacctttgtcgagctgatgcggcgcggcgatctccccgtgtggttgtcctacaaggtcgcgagcgccgggatttcctacaaagaccgggagtggtgcttcaccggtgagcgtaataaccagatcctggaagagaatatggaggtggagatctggacccgggagggagagaagaagaagctgcgaccgaggtggctggacgcccgcgtgtacgccgacccgatggccctgaaggattttaaggaattcgcgagcgggaggaagtctatcacgttggacatcctcaccgagattgccagtctgcccacctacctatcctcccgcgcgaagctcgccctggacaatatcgttatgctgcacaccaccgagcgaggcgggcgggcttaccagcacgcgctaaacgagctgcccgaaagcctcgagacgctcatgctggttgctctgctcggcgccatgaccgcagggatcttcttgtttttcatgcaagggaaggggattggcaagctgtccatgggcctcatcaccatcgctgtggccagcggactgctgtgggtcgccgagattcagccccagtggatagccgcctctatcatcttggaattcttcctgatggttcttctcatcccggaacccgagaaacagcgcactccacaggataatcagctaatatacgtgatccttacgatcctcaccataatcggccttattgcggccaatgaaatggggctgatcgagaagaccaagacagactttggcttctaccaggtcaagacggagaccaccatcctcgatgttgacctgaggccggccagcgcgtggaccctttacgcagtggcgacgaccattctcacccccatgctgagacacacgatcgagaacacgtcagccaacctgagcctcgccgccatcgccaaccaggcagccgtcctgatggggttgggcaagggctggcccctacaccggatggaccttggggtcccactactcgccatgggttgctactctcaggtgaacccgaccaccctgactgccagtttggtcatgctctccgtgcactacgccatcatcggacctgggctgcaagcgaaggccacgcgcgaggcccagaagcggaccgccgcgggcatcatgaagaacccaaccgtagacgggatcaccgtaatcgacctagaaccaatcagctacgaccctaagttcgagaagcagctcggccaggtgatgctgctagtcctctgcgcggggcagttactgctaatgcgcacgacctgggccttctgcgaggtcctgacgctggcaaccggccccatcctaacgctgtgggaaggcaaccccggccggttctggaacactaccatcgccgtgtccaccgcgaatatcttccggggctcttacctggccggggccggcctcgccttctcccttatcaagaatgcccaaacccccaggcgcgggaccggcaccactggggagacgctgggagaaaagtggaaacgtcaattaaactccctggatcgcaaggaattcgaggagtacaagcgttcaggcatcctagaggtggatcgcactgaagccaagtccgccttaaaggacggatccaaaatcaagcacgccgtcagccggggatccagcaagatccgctggatcgtggagcgggggatggtgaagccgaagggtaaggtcgtggaccttgggtgcgggaggggagggtggagctattacatggccaccctgaagaacgttacggaagtaaaaggctacaccaagggcgggcccgggcatgaggagcccatccccatggccacgtacggctggaacctcgtaaagctgcactccggagtggacgtcttctacaagccgactgagcaagtcgacacccttctctgcgacattggtgaaagcagcagtaacccgaccatcgaggaaggacgcactctgcgtgtcctgaagatggtcgaaccctggctctccagcaagcccgaattttgcatcaaggtgctgaacccgtacatgcccaccgtcattgaagagttggagaagctacagcggaagcacggaggcaacctcgtgcggtgtcccctttcccgcaattccacccatgaaatgtattgggtgagtggcgcaagcggtaacatcgtgtccagcgttaacaccacatccaagatgctgttgaaccggtttaccactcgccaccggaagcccacctacgagaaggacgtggacctgggcgccggaacgcgcagcgtcagtaccgaaaccgagaagccggacatgaccatcattggccggcgattgcagcgtctccaggaggagcacaaggaaacttggcactacgaccaagagaacccctaccgcacctgggcctatcacggaagctacgaggccccatccacgggcagcgcttcctcgatggtgaacggcgtggtcaagctactaaccaagccgtgggacgttatccccatggtgacgcagctcgccatgaccgacaccaccccattcggtcagcagcgggtcttcaaggagaaggtggatacacgcacgccccagcccaaacccggcacccgcatggtgatgacaacgacagccaactggctctgggccctgctcggcaagaagaaaaacccccggctgtgcacccgggaggagttcatctctaaggtccgctccaacgcggcgatcggtgccgtgttccaggaggagcaggggtggacaagcgcctccgaagctgtgaacgatagccggttctgggaactggtcgacaaggagcgcgccctccatcaggagggcaagtgcgagtcctgcgtgtacaacatgatgggaaagcgggagaagaagctgggcgagtttggccgagcgaaggggtccagggcgatctggtacatgtggctgggcgcccgatttctcgagttcgaggccctggggtttctgaacgaggaccactggttcggccgcgagaattcctggagcggcgtagagggagagggtctacaccggctcggatacatactggaggagatcgacaagaaagacggcgacctgatgtacgcggacgacacggcgggctgggacacccgcatcacagaggacgacttgcagaacgaggagttgatcaccgaacagatggcgccccaccacaagatcctcgccaaggccatcttcaaactgacgtaccagaacaaggtcgtaaaggtgctccggccaacgccccggggggcggtcatggacatcatttcccggaaggaccaaagaggcagcggccaagtaggcacctacggtttgaacacctttaccaacatggaggtgcaacttatccggcagatggaggccgagggcgtcatcacacaggacgacatgcagaacccgaaaggcctcaaggagcgagtggagaaatggctcaaggagtgcggagtggaccggctgaagcgcatggccatctccggcgatgattgtgtggtgaagcccctggacgagcgtttcgggaccagcctcctgttcttgaacgacatgggcaaggtgcgcaaggacatcccgcagtgggagcccagtaaggggtggaaaaactggcaggaggtccccttctgttcccaccacttccacaagatatttatgaaggacggcaggtccctcgtggtgccgtgtcgcaaccaggacgaattgatcggcagagcccgcattagccagggggcgggctggagtctgcgggagaccgcctgcctcgggaaggcctacgcccagatgtggagcctgatgtacttccaccggcgcgatcttcggctcgccagcatggccatatgttccgcggttcctacagagtggttccccacaagccgcaccacctggtccatacacgcccaccaccagtggatgacgacggaagacatgctgaaggtgtggaatagggtgtggatcgaggacaaccccaacatgaccgataagacgcccgtacactcctgggaggacataccgtacctcggtaagcgcgaggacttgtggtgtgggtctctgatcgggctgtcatcccgggccacctgggccaagaacatccacacggccattacccaggtgcggaacttgatcggcaaggaggagtacgtggactatatgcccgtcatgaagcgctacagcgccccatccgagagcgagggtgtgctctaa

SEQ ID NO: 26309 - RNA, 9867 nt, synthetic construct
  misc_feature 1..9867: note = derived and/or modified CDS sequence (opt11) from DENV-4__KJ579243__SS-prME
  source 1..9867: mol_type = other RNA
tctactataacgcttctctgcctcataccaacggttatggcattccacttgagcacaagggatggagaaccactcatgatagtagcaaaacacgaacgtggccgcccgctgttgtttaaaaccaccgaagggattaacaaatgtaccctaattgcaatggatctgggggaaatgtgcgaggacactgttacatacaaatgcccgctcctcgtaaacaccgaacccgaagacatcgattgctggtgtaacctaacgtccacctgggttatgtacgggacttgcacccaatccggcgagcggcgtcgtgaaaaacggagcgtggcactaacgcctcactcgggcatggggctcgagacgcgcgcagaaacttggatgagctctgagggcgcgtggaaacatgcccaacgagtggaatcctggatattaaggaaccccggattcgcgctgctcgctggatttatggcatacatgatagggcaaacaggaatccaacggaccgtgtttttcgtccttatgatgctcgtagccccaagctacgggatgcgatgcgtgggagttgggaacagggacttcgtcgaaggggtatcgggaggagcatgggtagacctggtgctggaacacggaggttgtgtcaccacaatggcacaaggaaaacccaccctggacttcgaactaaccaaaacaaccgcgaaagaagtagcgctcttacgaacgtactgcatagaggccctcattagcaacataaccacagccacacgctgcccaacccaaggggaaccttacttaaaagaagaacaagatcaacaatatatctgcaggagggatgtcgtagaccgcggctggggcaacggatgcggactatttggaaaaggcggcgtcgtgacctgtgctaaattcagctgttcgggaaaaatcactgggaacctggtccaaatcgaaaacctggaatacacggtggtggtcacagtccacaacggcgatacccatgcagtcggaaacgacacttccaaccatggtgtgacggccacgatcacaccccggtcaccgtcagtagaggtaaaactcccggattacggtgaactgacactagactgtgagccgcggagcgggatagacttcaatgagatgatattgatgaaaatgaagaagaaaacctggctcgtccataagcaatggtttctcgacctcccgttaccgtggaccacaggtgctgatacaagtgaagtacattggaactacaaagaacgtatggtaacattcaaggtaccccatgcaaagcggcaagacgtcacagtccttggcagtcaggaaggagcaatgcacagcgctcttgcaggagcaacggaagttgacagtggagatggaaaccacatgttcgcagggcacctaaagtgtaaggtacggatggaaaaactacgcatcaaaggtatgtcctacaccatgtgttcggggaaattctctatagacaaggaaatggcggaaacacagcacggaacaacagtggtaaaagttaagtacgaaggggccggtgctccgtgtaaagtccccatcgaaataagggacgtcaacaaagaaaaggttgtcggtcgcgttatctccgcaacgcccctagcagagaacacaaacagcgttacgaacatcgagctggaacccccattcggggattcatacattgtgatcggagtaggtaactcagcactcaccttacactggttccgaaagggtagttccataggaaagatgttcgagagcacttacagaggggcgaaacggatggcgatcttgggcgaaacggcctgggactttggcagtgtaggtgggctctttacaagtctgggaaaggcagtacaccaagtgtttggcagcgtctacacgaccatgttcggcggagtaagctggatgatccgaatattgataggctgtctagtactttggatcggaacgaacagtcgcaacacgtccatggcaatgacttgcatagccgtcggagggataacactgttcctaggcttcactgtacaggccgatatgggatgcgtcgtgagctggagtggacgagaactaaaatgcgggagcgggatcttcgtagtggacaatgtccatacgtggacagaacagtacaagttccaacccgagagtccagcgcgtctcgcgtcagctatacttaacgcgcacaaagatggtgtatgcggaatcaggagcactactcgcctcgaaaacgttatgtggaaacagatcaccaatgaactaaactacgtattatgggaaggcggacatgatctaacagtagtagccggtgacgtcaagggagtgctaactaaaggcaaacgcgccctaacacctcctgcgagtggacttaaatattcctggaaaacatgggggaaggctaaaatattcacaccagaagcccgaaattcaaccttcctcattgatggacctgatacctccgaatgcccgaatgaacgaagggcttggaacagtttcgaggtcgaagactacggattcggcatgttcactaccaatatatggatgaagttccgcgagggaagctccgaagtatgcgaccaccggttgatgagcgcagctataaaggatcaaaaagcagtccacgcggacatgggatactggatcgagagctccaaaaaccagacttggcagatcgaacgagcctctttaatagaggtgaagacatgcctatggccgaaaacacacaccctctggtcgaatggggtcttagagagccagatgctaattccaaaatcatacgcgggaccattcagccagcacaattaccggcagggttacgcgacccaaaccgtaggcccatggcacctaggaaagttagaaatagattttggggaatgccccgggacgaccgtaactattcaggaaaattgtgatcataggggcccgagcctgcgaacaaccactgccagcggtaaactcgtcacacagtggtgctgccgatcttgtacaatgccaccactacgcttcctaggcgaagatggctgctggtacggcatggaaatcaggccccttagcgagaaagaagaaaacatggtcaagtcacaggtaaccgccggccagggaacctcggaaaccttctcaatgggcctgctatgcctcacactgttcgtagaagaatgtctccgccggcgtgtgacacgcaagcacatgatcttagcggtggtcataacactctgcgcgataatactaggagggttaacttggatggatcttctccgggcgttaatcatcctcggagataccatgtccggcagaataggaggccaaacacacctagcaatcatggctgttttcaagatgagccccgggtatgtactcggcgtattcctaaggaagttgacaagcagagaaacggctctgatggtaatcggaatggctatgacaacaacgctatccataccccatgacctcatggaactaatagatggcatctcactcggcctgatacttctcaagatagtaacacaattcgataatactcaagttggaactctcgccctatcgctaacattcataaggagcacaatgagcctcgtgatggcatggcgcaccataatggcagttctattcgtggtcacacttataccgttgtgccgtaccagttgcctacagaagcagagccactgggtagagataacggctctgattcttggggcacaagcactccccgtgtacctcatgaccctcatgaagggagccagcagacgctcatggcctctaaacgaaggaatcatggcagtggggctggtatccctgctgggtagcgctctactcaaaaacgatgtacccctggcagggccaatggtagccggcgggctattgctcgcggcgtacgttatgagcggatcaagcgcagatttatcacttgaaaaggcagccaacgtacaatgggacgaaatggccgacatcacgggcagcagcccgatcatcgaggttaaacaggacgaagatggcagctttagcatcagggacgtggaagaaacgaacatgataacgctcttggtcaagttagcactgataaccgtgtcggggctttaccccctagcgattccaatcacaatgaccctgtggtacatgtggcaagtgaaaacccaacgaagtggcgcactctgggacgtgcctagccccgcagcaacacaaaaagcagcgctcagcgaaggcgtgtaccgcatcatgcagcgtggcctattcggcaaaacacaggtcggcgtcggcatccatatggagggcgtcttccacactatgtggcacgtcacacgaggatccgtaatctgccacgaaacgggtcgcctggaaccgagttgggcggacgtaaggaatgatatgatatcctatgggggcgggtggagactaggagacaaatgggacaaagaagaagacgtacaggtgctggccatcgagcccggcaagaacccaaaacacgtccaaacaaaaccaggtctattcaagactttaacaggcgagatcggtgcagttacgctagactttaagccggggacctcaggaagtccgataataaaccgaaaaggcaaagtaatcgggctatacggaaacggggtcgtcacaaagtccggcgactacgtaagcgcaataacacaggccgagcggataggcgaaccagactatgaagtcgacgaggatatcttccgcaaaaagagacttaccatcatggacctacatccgggcgctggcaaaacaaaacgcatactaccctccatcgtaagggaagcgctgaaaaggcgactgaggaccctaatcctagctcccacaagagtggtcgcagcagagatggaggaggctctccgaggcctcccgatcagataccaaacccctgcggtgaaaagtgagcacacgggaagggaaatcgtagacctaatgtgtcatgccacattcacgactcgactcttaagttcaactcgcgtccccaattacaacttgatcgtcatggacgaggcacactttaccgacccctctagcgtcgcagcacgaggctacatcagtacgcgagtagaaatgggcgaggcggccgccatattcatgacggcaacacccccgggtgcgactgacccattcccccagtccaacagcccgatagaagacatcgagcgagagataccagagcgctcgtggaacaccgggtttgactggatcaccgattaccagggcaagacggtctggttcgtaccatccatcaaggcaggaaacgacattgcaaactgcctgcggaaatcggggaaaaaggtaattcaactgtcacgcaagacgttcgacacagagtatccaaaaacgaaattaacggactgggatttcgttgtgactacagacatatcggagatgggagcaaattttagagccggacgagtcatagacccgagacgatgtctaaaacctgtaatactgactgacggaccagaacgcgtaatactagcgggcccaattccagtcacccctgcgagcgcagcgcagcgccgtggccggattggtcggaacccggcccaagaggacgaccagtacgtgttctcaggagacccgctaaagaacgacgaagaccacgctcactggacagaagcaaaaatgctacttgacaacatatacacacccgaaggcataatacccacactgttcggtcccgagagagagaaaacgcaagcaatagacggagagtttaggctgcgtggcgagcaacggaaaacatttgtagaattaatgcgtcgaggggacctaccggtatggttaagttacaaggtcgcttccgcaggcatcagctacaaagacagagaatggtgcttcaccggagaacgcaacaaccaaatcctggaggaaaacatggaagttgaaatttggacccgggaaggggagaagaagaaactgcgtcctaaatggttagatgctcgcgtgtacgcagacccgatggccttaaaagatttcaaggaatttgcctccggacgtaaatcaatcaccttggacatattaacagagatagcctcactaccaacctatttgagctccagagcaaaactggctctcgacaacatagtgatgctccacacaaccgaaaggggaggccgtgcgtatcaacacgcattaaacgagcttccggaatccctcgaaacattaatgcttgtagccttattgggcgcaatgaccgccggtatcttcctatttttcatgcaaggcaaggggatcgggaagttatccatgggactaataactatagcagtggcatccggcctactctgggtagcagaaatacagccgcaatggatagcggcgtctataatactcgaatttttcctcatggtactactcataccagaacctgaaaaacaacgcacaccacaagacaatcaactcatctatgtaattctcactattctaaccatcattggactaatagcagccaacgaaatgggcctaatcgagaagacgaagacggacttcggcttctatcaagtgaaaacagaaacgaccatactagacgttgatttacggcctgcatcggcctggacactctacgcagtagcaaccacgatcctgacgcccatgctccggcataccatagaaaacacgagcgcgaacttgtcgctggccgccatagctaaccaggccgcagtcttgatgggacttggcaaagggtggccactacaccgcatggacttaggcgtcccacttcttgctatgggctgctactcacaggtaaacccaacgaccctcacagccagcctcgtaatgctgcttgtacattacgccataatcggacctggactacaagcgaaagcaacacgggaagcacaaaagaggacagcagccggaataatgaaaaacccgacagtagacggtatcaccgttatagacctcgaacccatctcttacgacccgaaatttgagaaacagctcggacaggtaatgctgcttgttctctgcgcgggtcaactcctacttatgcgaacgacttgggccttctgcgaggtactcacgctggccacgggacccatcctcaccctgtgggaagggaacccgggacgattctggaatacaacaatagccgtaagtacggcaaacatatttcgcgggagttacctagctggcgcaggactggcattctcattaattaaaaacgcacaaaccccgcgccgagggaccggcaccgcgggggaaacactcggggaaaagtggaaacggcaactgaactcactggaccgcaaggagttcgaagaatataagcggagtggcattctagaggtcgaccggacggaagccaagtccgcgctcaaagacgggagcaaaattaaacacgccgttagtcggggatccagtaaaatacgttggatcgttgaacgtggaatggtaaaacccaaagggaaagtggtagacctcggatgtggccgcggagggtggtcttactacatggcaacgctcaaaaacgtgaccgaggttaagggatacacaaagggaggtcctgggcacgaagaaccgatccccatggcgacttacggctggaacttagtaaagctccatagcggagtagacgtattttacaagcccacagagcaagtcgacaccttgctctgcgatataggggaatcaagctccaaccccaccatagaagaaggccgaaccctaagggttctcaaaatggtggaaccgtggctttcatcaaagccagagttctgtatcaaagtcctgaacccgtacatgccaactgtcatcgaagaactagagaagctgcaacgtaagcatgggggcaacttagtaagatgcccactgagccgcaacagcacgcacgagatgtactgggtctcgggcgccagcggcaacatcgtaagctctgtaaacacgaccagcaaaatgctgctcaaccgatttaccacacgacacaggaagcccacctatgaaaaagatgttgatctcggagcgggtacgagatccgtaagcaccgaaacagaaaaacccgacatgacaattataggaaggcgcttacaaagactacaggaagaacataaagagacctggcattacgaccaagaaaacccgtaccggacgtgggcctaccatggcagctacgaagcaccgtcaacaggctccgcgagttctatggttaacggcgtagtgaagctcctgaccaaaccatgggacgtaattcccatggtcacccaattagcaatgaccgacacgacacccttcggacaacagagggtatttaaagagaaagtcgacaccagaacaccgcagcccaaaccaggcacgaggatggtcatgacgaccacggctaactggctctgggcactactaggcaagaagaaaaatcccaggctgtgcacgcgagaggagttcatctcaaaagtgcggtccaacgccgccattggggcagtgttccaagaggagcaagggtggaccagcgcatcagaagccgtaaacgactcaaggttttgggaactggtcgacaaagaacgcgcgctgcaccaggaaggaaaatgcgagtcgtgcgtatacaacatgatgggcaaacgagagaagaaacttggagaatttggtcgagcaaaaggatcgcgagctatatggtatatgtggctgggagcaagattcctagagtttgaggccctggggttcctcaacgaggatcattggttcggaagagagaactcttggtccggagtcgaaggggagggattacaccgacttggctatatattggaagagatcgacaagaaagacggcgacctcatgtacgctgatgatactgcgggctgggacacgcgtataacagaagacgacctacaaaacgaggaactgataacggagcagatggcacctcaccataagatacttgcaaaggcgatattcaagctaacatatcaaaacaaagtagtaaaggtcctacgacccacgccgagaggggcggtaatggacataatatcgagaaaagatcaacgagggtctggacaagtaggaacctacggactgaataccttcaccaacatggaagtgcaactgatccgccaaatggaagccgaaggggtcatcactcaggacgacatgcaaaacccgaaaggcctcaaggaaagagtggagaaatggctccgcgagtgtggcgtagatcgactcaagcggatggccatcagcggggacgactgcgtcgtcaagccattggacgagcgattcgggacatcattgctattcctgaatgatatgggcaaggtccgaaaagacattccccagtgggaaccctcaaaaggctggaaaaattggcaagaggtgccattctgctctcaccacttccacaagatattcatgaaagacggaagatccttggtagtaccatgtcgaaaccaggatgagctgataggacgagcaagaataagccaaggcgcgggatggagcctccgcgaaacggcatgcttaggcaaagcctacgcccagatgtggagtctcatgtacttccacagacgagacctccggctagcgagcatggcaatatgctcagcagtacccacggaatggttccccacgtcacgcactacatggtccattcacgcccatcaccagtggatgacaacagaagatatgctgaaggtctggaaccgagtctggatagaagacaacccaaacatgatagacaagacgcctgttcacagctgggaagacattccctacctcggcaaaagagaagatctgtggtgtggatcacttattggactctccagccgagccacgtgggccaagaatatccatacagcaataacccaagtccgaaacttaataggaaaagaagagtatgtggactacatgccggtgatgaagcggtacagcgcgccgtcagaatccgaaggggtactatag

SEQ ID NO: 26310 - RNA, 9867 nt, synthetic construct
  misc_feature 1..9867: note = derived and/or modified CDS sequence (opt11) from DENV-4__KJ579246__SS-prME
  source 1..9867: mol_type = other RNA
agcaccatcacgctgctctgcctgatccccacggtgatggccttccatctgtcgacgcgcgacggcgagccgctgatgatcgtcgccaagcacgagcgggggcgccccttattattcaagaccaccgagggcatcaacaagtgcacactcatagcgatggacctgggggagatgtgcgaggacacagtgacctacaaatgcccccttctcgtgaataccgagcccgaagacatcgactgctggtgcaacctgacgagtacctgggtcatgtacggcacatgcacccagtccggggagcggcgccgggaaaagcgcagcgtggccctgacgccgcactcgggcatgggcctcgaaactcgggccgagacctggatgtcctctgagggggcctggaaacacgcccagcgcgtggagagctggatcctgcggaacccaggcttcgcgctgctcgcagggtttatggcttacatgatcgggcagactgggattcagcggacggtcttcttcgttctgatgatgctggtggccccctcctacgggatgcgctgcgtcggcgtggggaatcgcgatttcgtggagggcgtatccgggggcgcctgggtggatctcgtgctggaacacggcgggtgtgtcaccaccatggcccagggcaagcccaccctggacttcgagttgacgaagaccaccgccaaagaggtggccctgctgcggacctactgcatcgaggccctcatttccaatataaccaccgccacccgctgcccgacccagggggaaccctacctgaaggaggagcaggaccaacaatacatttgccggcgcgacgtggtcgaccggggttgggggaacggctgcggcttatttggcaagggcggggtggtcacgtgcgccaagtttagctgttccggtaagatcaccgggaacctcgtccaaatcgagaacctggaatataccgtggtggtcaccgtgcacaatggcgatacgcacgccgtcggcaacgacaccagcaaccacggggtgacggccaccatcacgccccgctcccccagcgtggaagtcaaactcccggactatggcgagctcaccttggactgcgagccccggtccgggatcgacttcaacgagatgatcctgatgaagatgaagaagaaaacatggctcgtgcataaacaatggttcctcgacctgcctctaccttggacaaccggagccgacacgtctgaggtgcactggaactacaaggaacgcatggtcaccttcaaagtgccacacgcgaaacggcaggacgtgaccgtcctggggtcccaggagggcgccatgcacagcgcgctggccggcgcaaccgaggtggacagcggggacggcaaccatatgttcgcggggcacctcaagtgcaaagtgcgcatggagaagctgcgcatcaagggcatgtcctacacgatgtgcagcggcaagttcagcatcgacaaggagatggctgagacccagcatgggaccaccgtcgtgaaggtgaagtacgagggcgccggggccccctgcaaggtccctatagagatccgggacgtgaataaggagaaggtggtcggacgcgtgatcagcgccacgcccctggcggagaacaccaacagcgtgaccaacatcgaactcgagcctcccttcggagacagctatatcgtcatcggcgtgggaaactccgccctgactctgcactggttccggaaggggtcctccatcggcaagatgttcgaaagcacgtaccgcggggccaagcggatggccatcctcggcgagaccgcgtgggacttcgggtccgtgggcggcctgtttaccagcctggggaaggccgtccaccaggtcttcggctccgtgtacacaacgatgttcgggggtgtgtcttggatgatccgcatcctcatcgggttcctggtgctgtggatcggcaccaactcccggaacacctcaatggccatgacctgcatcgcagtgggcgggattacgctcttcctggggtttaccgtccaggcggacatggggtgcgtggtgtcctggagcggccgcgagctgaagtgtgggtctggcatattcgtcgtggataacgtgcacacctggaccgagcagtacaagttccagcccgagagccccgctcgcctagcttcagccatcttgaacgcgcacaaggacggcgtctgcgggatccgctccacgacccggttggagaacgtgatgtggaagcagatcaccaacgagctgaactacgtgctctgggagggcgggcacgacctgaccgtcgtcgccggcgacgtgaagggcgtcctgacgaaggggaaacgggcgctcacccctcccgccagcgacttaaagtactcctggaagacctggggcaaagccaagatcttcacacccgaggcccggaacagcaccttcttgattgacgggcccgacacttccgagtgcccgaacgagcgacgggcctggaatagcttcgaggtggaggactacggcttcgggatgttcaccaccaatatatggatgaagttccgcgagggctccagcgaggtgtgcgaccaccggctgatgtccgcggccatcaaggaccagaaagccgtccacgccgacatgggctactggatcgagtcatccaagaatcagacatggcagatcgagagagccagcctcatcgaggtgaaaacctgcttatggcccaagacccacaccctctggtccaacggagttctggagagccagatgctgatccccaagtcctacgccggacctttcagccagcacaactaccggcaggggtacgccacccagacggtcggcccctggcatttgggtaagctggagatcgacttcggcgagtgccccggcaccaccgtgactattcaggagaactgcgaccaccgcgggccctccctgcgcacgaccaccgcaagcggcaagctcgtgacacagtggtgctgtcggagctgcacgatgccgcccctgcgcttcctgggggaggacggctgttggtacgggatggagatccggcccctatccgagaaggaggagaatatggtaaaaagccaagtgaccgccggccagggcacatccgagaccttcagcatgggtctgctctgcctcacgctgttcgtcgaggagtgcctgaggcgacgcgtaacccggaagcacatgatactcgcggtggtcatcaccctgtgcgccatcatccttggcgggctcacgtggatggacttactccgcgccctgatcatcctgggcgatacgatgtccggacggatcggaggccagacccatctggctatcatggcggtgttcaagatgtcgcccgggtacgtgctcggcgtattcctgcgcaagctgacctcccgggaaaccgcgctcatggtgatcggcatggccatgacgaccaccctcagcatcccgcacgacctgatggaactcatcgacggcatctccctgggtctgatccttctgaagatcgtgacccagttcgacaacacgcaggtcgggaccctggcgctctcccttaccttcatacgcagcaccatgagcctggtgatggcatggcggacgatcatggcagtactcttcgtcgtaaccctgatccccttgtgccgcacctcctgcttacagaagcagagccactgggtggagattaccgcgctgatactgggcgcccaagccctccccgtctacttaatgacgctgatgaagggcgcctcccggcgctcttggcctctcaacgaaggcatcatggccgtggggctggtgtctctgctcggcagcgccctgctgaagaacgacgtcccgctcgccggccccatggtggccgggggactgctgctcgccgcgtacgtgatgtccggaagcagcgccgacctgtccctggagaaggccgccaacgtccagtgggacgagatggccgacatcaccggcagctcccccatcatcgaggtgaagcaggacgaagacgggagcttctctatccgagacgtggaggagacgaacatgataaccctcctggtcaagctggcgctcatcaccgtgagcgggctgtaccccctggccatcccgatcaccatgaccctctggtacatgtggcaggtcaagacccagcggtccggcgccctgtgggacgtccccagccccgccgccacccagaaggcggcactgtccgagggggtgtatcggatcatgcagcgcggcctcttcggcaagacgcaggtgggcgtcgggatccacatggagggcgtgttccacacgatgtggcacgtgacccggggcagcgtcatctgccacgagaccgggcgcttagagccatcctgggccgacgtccgcaatgatatgatcagctacggcgggggctggcggctgggagataagtgggacaaggaggaggacgtgcaggtcctcgccatcgagccgggaaagaaccccaagcacgtgcagacgaagccaggcctgttcaagaccctgaccggggagatcggcgccgtaaccctcgacttcaagccagggacgtccggcagcccgatcatcaatcgcaagggaaaggtcatagggctgtacggcaacggggtcgtgaccaagtccggcgactacgtcagcgccatcacccaggccgagcggataggggagccggactacgaggtggacgaggacatttttcgcaagaagcggctgacgatcatggatctccaccccggcgccggcaaaacgaagcgcatcctgccatccatagtgcgggaggccctgaagaggcggctgcgcaccctcatcctggcccccacgcgggtcgtggccgcggagatggaagaagcgctgcgcgggctccccatccggtaccagacccctgccgtgaagagcgagcacacgggccgcgagatcgtcgacctgatgtgccatgcaacgttcaccacccggctgctctccagcacgcgcgtgcccaactacaacttgatcgtgatggacgaggcccacttcactgacccctcgagcgtcgccgctcgggggtacatcagcacccgcgtggagatgggtgaggcggccgccatcttcatgaccgccaccccccccggcgccaccgatccgttccctcagagtaacagccccatcgaggacatcgagcgggagatccctgagcgctcctggaacaccggcttcgactggatcaccgactaccagggcaagactgtctggttcgtcccgagcatcaaggccggaaacgacatcgcgaactgcctgcgcaagtccggtaaaaaggtgatccagctcagccggaagaccttcgacaccgagtacccaaagaccaagctgacggactgggactttgttgttaccaccgacatctccgagatgggggccaactttcgcgccggtcgggtgatcgacccccgccggtgcctgaagcccgtcatcctcaccgacgggccggagcgcgtgatcctggcaggccccatcccggtgacgcccgcgagcgccgcccagcggcgcgggcggatcgggcgcaacccggcccaggaggatgaccaatatgttttcagtggagaccccctgaagaacgacgaggaccacgcccactggacggaggcgaagatgctcctggacaacatctacacccccgaggggatcatccccaccctgttcggtccagagagagagaaaacgcaggctattgacggcgagttccgcctccggggagagcaacgcaagaccttcgtggagctgatgcgacgcggggacctgcctgtgtggctcagctacaaggtagcctccgcaggtatcagctacaaggaccgggaatggtgcttcacaggagagcgcaataaccagatcctggaagagaacatggaggtcgagatctggactcgggagggggagaagaaaaagctgcgcccaaagtggttagacgcccgagtgtacgcggaccccatggccctgaaggatttcaaggagttcgcctccgggcgcaaaagcatcaccctggacattctcacggaaatcgcctcccttcccacctacttaagctcccgcgcgaagctcgccctggacaacatcgtcatgttgcacacgaccgagcggggcgggcgcgcataccagcacgcccttaacgaattgcccgagagcctggaaacgctcatgctggtggccctgctgggagcgatgaccgccgggattttcctgttcttcatgcagggcaaggggatcggcaaactcagcatgggcctcatcacaatcgccgtggcctctgggctgctgtgggtcgccgagatacagccccagtggatcgcggcgagcatcatcctggagttcttcctgatggtgctgctcatcccagagcccgagaagcagcggaccccgcaggacaaccagctaatctacgttatcctcacaatcctcacgatcatcggcctgatcgccgccaacgaaatggggctgatcgagaagaccaagaccgactttggcttctaccaggtaaagacggagacgacaatactcgacgtggacctgcgcccagcctccgcatggaccctgtacgccgttgccacgaccatactcacgcctatgctgcggcacacaatagagaacacgagcgccaacctgtccctcgccgcgatcgcaaatcaggccgccgtcctgatggggctgggaaagggctggcctctacatcgcatggacctgggggtgcccctgctcgccatgggctgctacagccaggtgaaccccaccaccttgaccgcctctctggtaatgctcctggtgcactacgcaatcatagggccgggcttgcaggctaaggccacgcgggaggcgcagaagagaaccgccgccggaatcatgaagaaccccaccgtggacggcatcactgtcattgacctcgagcccatcagctacgaccccaagttcgagaaacagctgggccaggttatgctgctcgtgctgtgcgccgggcagctgctcctgatgcgtacgacctgggccttttgcgaggtcctgaccttagcgaccggaccgatcctgacgctgtgggaggggaaccccggccgcttttggaacaccactatcgccgtgtccaccgccaacatattccggggcagctacctcgccggggccggcctggcgttctccctgatcaaaaacgcccaaacgccccgcagggggaccggcacggccggggagacactaggcgagaaatggaagcggcaactgaatagcctcgaccggaaggagttcgaggaatacaagcgttccggcatcttagaggtggaccggaccgaagccaagagcgccctgaaggacggttccaagatcaagcacgcggtcagccgcggctccagcaagatccggtggatcgtagagcgcgggatggtgaagcccaagggtaaggtagtggacctggggtgcggccgcggcgggtggtcctactacatggccacgctcaagaacgtgaccgaggtcaagggatacaccaaagggggcccggggcacgaggagcccatccccatggctacctacggctggaacctggtgaagctgcacagcggcgtggacgtcttctacaagcccacggaacaggtggacaccctcctgtgcgatatcggggagagctccagcaacccgaccatcgaggagggccgtaccctccgcgtgctcaagatggtcgaaccctggctgtccagcaagcccgagttctgcattaaggtgctgaacccctacatgccgacggtgatcgaggaactggaaaagctccagcggaagcatgggggcaacctggtccgctgccccctgtcccggaacagcacccacgagatgtactgggtgtcgggtgcctcggggaacatcgtctccagcgtgaacaccacgtccaagatgctcctgaatcgcttcacgacccggcatcgcaagcccacctacgagaaggatgtggacctgggggcgggaaccagaagcgtctccacggagaccgagaagcccgacatgacaatcatcggccgacgtctccagcgcttacaggaggagcataaggagacttggcactacgatcaggagaacccgtaccggacatgggcctaccacgggagttacgaggccccctccaccggcagcgcctccagcatggtgaacggggtggtaaagctgttgaccaagccctgggatgtgattcccatggtgacgcagctggccatgacggacaccacccccttcgggcagcaacgcgtcttcaaggagaaggtggacacacggacgccccaacccaagccgggcacccgcatggtgatgacgacgacggcgaactggctgtgggccctcctggggaagaaaaaaaacccccggctctgcacccgcgaggagttcatctccaaggtccggagcaacgccgccatcggcgccgtgttccaggaagagcaggggtggacctcagcgtccgaggccgtaaacgactcccgcttctgggagctagtcgacaaggagcgggccctgcaccaggagggtaagtgcgaaagctgcgtgtacaacatgatgggcaagcgagagaagaagctcggggagttcggccgcgccaaggggagccgggccatctggtacatgtggctcggggcgcgcttcctcgagttcgaggccctggggttcttgaacgaggatcactggttcggccgggagaactcgtggagcggcgtggagggggagggcctgcaccgcctgggatacatcctcgaggagatcgacaagaaggacggcgacctgatgtacgccgacgacaccgcaggctgggacacgcggattaccgaggacgacctgcagaacgaggagctcatcaccgagcagatggcgccccaccacaagatcctggccaaggccatcttcaagctgacctaccagaacaaggtcgtgaaggttctccggcccaccccgcggggggccgtaatggacatcatctcccgcaaggaccagcgggggagcgggcaggtgggaacgtacgggctaaacaccttcaccaacatggaggtgcagctgatccgccagatggaggccgagggcgtcatcactcaagacgacatgcagaaccccaagggcctcaaagaacgcgtggagaagtggctgcgcgagtgcggggtggaccggctgaagcgcatggcgatatccggagacgactgtgtcgtcaagcccctcgacgagcggttcgggacgagcctgctgttcctcaacgacatgggaaaggtgcgaaaggacatcccccagtgggagccgtccaaggggtggaagaactggcaggaggtccccttctgcagccaccacttccataagatcttcatgaaggacggccggtcgctggtggtcccctgccgcaaccaggatgagctaatcggccgggcccgcataagccaaggggccggctggtccctcagagagactgcctgcctggggaaggcttacgcgcagatgtggagtctaatgtacttccaccgacgcgacctccggctggcctccatggctatatgttctgccgtccccacggagtggttcccgaccagcaggacaacctggtccatccacgcccaccaccagtggatgaccaccgaggacatgctgaaagtgtggaaccgggtgtggatcgaggacaaccccaacatgatcgacaaaactcccattcacagctgggaggacatcccctacctcggcaagcgcgaagacctgtggtgcggatccctgatcggcctcagctcccgggcgacctgggccaaaaacatccacaccgccatcacccaggtccgcaacctgatcggcaaggaggaatacgtggattacatgccggtgatgaagcggtacagcgccccctccgagagcgagggggtcctgtga

SEQ ID NO: 26311 - RNA, 9867 nt, synthetic construct
  misc_feature 1..9867: note = derived and/or modified CDS sequence (opt11) from DENV-4__KJ579248__SS-prME
  source 1..9867: mol_type = other RNA
agcaccatcaccttgctctgcctgattcccaccgtgatggcattccacctgagcacccgggacggcgaacccctcatgatcgtggccaagcacgagcgggggcggcctctgctgtttaagaccaccgagggcatcaacaagtgcacactcatcgcgatggatttaggggagatgtgcgaggacaccgtgacctacaagtgccccctgctggtgaacaccgagccagaagacatagactgctggtgcaatctcacgtccacttgggtgatgtatgggacctgcacccagtccggggagcgacgccgggagaaacgcagcgtggcgctgactccgcactccggcatggggctcgagacccgggccgaaacctggatgtcctccgagggggcctggaagcacgcgcagagagtggagagctggatcctgcggaaccctggatttgcactgctcgccgggttcatggcctacatgatcggtcagaccggtatccagcgcacggtctttttcgtgttaatgatgctggtggccccctcctacggcatgcggtgcgtcggcgtggggaaccgcgactttgtcgagggcgtcagcggaggcgcgtgggtggacctcgtcctggaacatggcgggtgcgtcaccaccatggcccagggcaagcccactcttgactttgaactcacgaagaccaccgccaaggaagttgccctactgcggacctactgtatcgaggcccttatctcgaacataacgaccgcgacgcgctgcccgacccagggggagccatacctgaaggaggagcaagaccagcaatatatctgtcggcgagacgtggtcgaccggggctggggcaacggatgcggcctattcgggaagggcggggtggtgacgtgcgcgaaattcagttgctccggcaagatcaccgggaacctcgtccagatcgagaacctggaatataccgtggtggtcactgtgcacaatggcgacacgcacgccgtcggcaacgacaccagcaaccacggggttaccgccaccataacgcccagatcccccagcgtggaggtgaaactgccagactacggcgagctcactctggactgcgagccccggtctggaatcgacttcaacgagatgatcctgatgaagatgaaaaagaagacctggctcgtgcacaagcagtggttcctggatttacccctcccctggaccaccggggccgatacttcagaggtccactggaactacaaggagcgcatggtcaccttcaaggtgccgcacgcgaagcggcaagacgtgactgtgctggggtcccaagagggcgccatgcactcagccctggccggcgccaccgaggtggacagcggcgacggaaaccacatgttcgcgggacacctcaagtgcaaggtgcgcatggagaagctgcgcatcaaggggatgagctacacgatgtgcagcggcaagttttccatcgacaaggagatggccgagacccagcatgggaccaccgtcgtgaaggtgaagtatgagggagccggagccccctgcaaggtcccaatagagatccgggacgtcaacaaggagaaggtggtcggccgcgtgatctcggcaacgcccctcgcggagaataccaattctgtaaccaacatagagctcgagccgccattcggcgacagctacatcgtcatcggcgtgggcaactcggccctgaccctgcattggttccggaaggggagctccatcggcaagatgtttgaaagcacgtaccgcggggccaagcggatggccatcctgggtgagaccgcgtgggactttgggtcggtagggggcctgtttacctcactggggaaggccgtccaccaggtgtttggctccgtgtacaccacgatgttcgggggcgtcagctggatgatccgcatcctcatagggttcctggtgctgtggatcggcaccaactcccggaacaccagcatggccatgacttgcatcgcagtaggagggattacactgtttctcggattcaccgtccaagccgacatggggtgtgtggtgtcctggagcggccgagaactgaagtgcgggtccggcatattcgtcgtggacaatgtgcacacctggaccgagcagtataaattccagcccgagagccccgcgcggctggcctcagccatactcaacgcccacaaggacggcgtctgcgggatcaggtccacgacccggctggagaacgtgatgtggaagcagatcaccaacgagctcaactatgtactgtgggaaggagggcacgacctgaccgttgtggccggcgacgttaagggcgtcctgacgaaagggaaacgcgcgctcaccccacccgcctctgatctgaaatactcctggaaaacctggggcaaggccaaaatctttacccccgaggcccgaaacagcacgttcctcattgacgggcccgacacctccgagtgcccgaacgagcgccgggcctggaacagcttcgaggtcgaggactacggcttcgggatgttcaccaccaacatctggatgaagttccgtgagggctccagcgaagtttgcgatcaccggctcatgtccgcggccatcaaggatcagaaggccgtacacgccgacatgggctactggatcgagagctcaaagaatcagacgtggcagatcgagcgcgcgagcctgatcgaagtgaagacgtgcctgtggcccaagacccacacgctctggtccaacggggtgctggagagccaaatgctgatccccaagtcctacgccggcccgttcagccagcacaactatcggcaggggtacgccacccaaacggtcggcccctggcatctcggcaagctagaaatcgacttcggcgagtgccccggcacaaccgtgaccatccaggaaaactgtgaccatcgtggcccctccctgcgcacgaccacagccagcggcaagctcgtgacccagtggtgctgtcggagttgcacgatgccgccgctgcgcttcctgggggaggacggctgctggtacgggatggaaattaggcccctatccgagaaggaggagaacatggtcaaatcacaggtgaccgccggccagggcacctccgagaccttcagcatggggctgctgtgcctcacactgttcgtcgaggagtgtctgcgccggcgcgtgacacgcaagcatatgattctcgcggtggtcatcaccctgtgcgccatcatcctaggcgggctcacctggatggacctactgcgcgccctgatcatgctgggcgacacaatgtccggccgggtcggcggtcagacccacctggcgatcatcgccgtgttcaagatgagccccgggtacgtgctcggggtgttcctgcgcaagctgacctcccgggagaccgcgctcatggtcatagggatggccatgacaacaaccctgagcatcccgcacgatctgatggagctcatcgacggcatctccctgggcctgatcctccttaagatcgtaacccagttcgacaacacccaggtggggaccctggccctcagcctgaccttcatccgctccacaatgtcacttgtgatggcctggcgaaccatcatggccgtcctcttcgtggtgaccctgatccccctgtgccgaacctcgtgtctccagaaacagagccactgggtcgagatcaccgcgctgatcctgggcgcccaggctctcccagtgtacctcatgacgctgatgaagggagcctcacggcgcagctggcccctcaacgagggaatcatggcggtggggttagtctccctgctcggttctgccctgctgaagaacgatgtgccgctcgccggccccatggtggcagggggcctgctattagctgcgtacgtcatgtccgggtcttccgccgacctgtccctggagaaggcagcgaacgtgcaatgggatgagatggccgacataaccggatcttcccccatcatcgaggtgaagcaggacgaggacgggagcttctccatccgggacgtcgaggagacgaacatgatcaccctactggttaaactggccctcataacggtgagcggactctaccctcttgcgatcccgatcaccatgaccctctggtacatgtggcaggtcaaaacccagcgcagtggcgccctgtgggacgtgcccagccccgccgcaacgcagaaggcggccctgtccgagggagtctaccgaatcatgcagcgcggcttattcggcaagacgcaggtcggggtcgggatccacatggagggggtgttccacaccatgtggcacgtcacccggggcagcgtgatctgccacgagacagggcgccttgagccctcctgggcggatgtgcgcaacgatatgatcagctacggcgggggctggcggctgggcgacaagtgggacaaggaggaagacgtccaggtactcgcgattgagccggggaagaaccctaagcacgtgcagaccaaacccggcttgtttaagaccctgaccggcgagatcggagccgtcacactcgacttcaagcccggcacgtccggttccccgataatcaatcgaaagggcaaggtgatcgggctgtacggtaatggggtggtcaccaagtccggcgactacgtcagcgcaatcacgcaggccgagcggatcggggagcccgactacgaggttgacgaggacatattccgcaagaaacggttaaccattatggacctccaccccggcgccggcaagacgaagaggatccttccgtccatcgtccgggaggccctgaaacgccggcttcgcaccctcatcctggcccccacccgggtggttgccgctgagatggaggaggccctgcgcggcctcccaatccggtaccagacccccgcggttaagagcgagcacaccggacgggagatagtcgatctgatgtgccatgctaccttcacgactcggctgctctccagcacgcgcgttccgaactacaacttgatcgtcatggacgaggcccacttcaccgacccaagctcagtcgccgcccgggggtacataagcacgcgcgtagagatgggcgaggccgctgcgatcttcatgacagcgacaccgcccggggccaccgacccgttcccccagtccaacagccccatcgaagacattgagcgggagatccctgagcgctcctggaacaccggattcgattggataaccgactaccagggcaagacggtgtggttcgtgccgagcatcaaggctgggaacgatattgcgaattgcctgaggaagtccggcaagaaggtaatacagttaagccggaagacctttgacaccgagtacccaaagaccaagctgacggactgggacttcgttgtgaccaccgacatctccgagatgggtgccaactttcgggccggccgggtcatcgacccccgtcggtgcctgaagcccgtcatcctcacagacgggccggagagggtgatcctggccggccccatccccgtaacgcccgcgtcagccgcccagcggcgtggccggatagggcgcaaccctgcgcaggaggacgaccaatacgtgttctccggcgatcccctgaaaaacgacgaagatcacgcgcactggaccgaggcgaagatgctcctcgacaacatatatacccccgaggggatcatccccaccctcttcggtccggagcgggagaaaacgcaggcaatcgatggtgagttccgcctgcgcggtgagcagcgcaagaccttcgttgagctgatgcggagaggcgatctgcccgtctggctcagctataaggtcgcgtccgcgggtatcagctacaaagaccgggagtggtgtttcaccggggagcgcaacaaccagatcctggaagagaacatggaagtggagatctggacacgggagggggagaagaagaagctgcgccctaagtggctcgacgcgcgggtctacgcggaccccatggccctgaaggatttcaaggagttcgcctccggccgcaagtccatcaccctggacatcctcacggaaatcgcctccctgccgacctacctgagctcccgcgccaagttagcgcttgacaacatcgtgatgctacacaccacggagcggggcggacgcgcctaccaacacgccttgaacgagttgcccgaaagcctcgagacgttaatgctggtggcccttctcggcgcgatgaccgccgggatcttcctgttcttcatgcaaggcaaggggataggtaagctaagcatgggcctcatcacgatcgccgtggcttcggggttgctgtgggttgccgagatccagccccaatggatcgctgcaagcatcatactcgagttcttcctaatggtgctgctcataccggagccagagaagcagagaaccccacaggacaaccagcttatctatgtcatactgacgatcctcaccattatcggcttaatcgccgccaacgaaatgggactgatcgagaagaccaagactgatttcggcttctaccaagtgaaaacggagaccaccatcctcgacgtggacctgcgccccgcctcggcgtggaccctttacgccgtcgccacgacgatcctcacaccgatgctgcggcatacgattgagaacactagcgctaacctgtcgctcgccgcgatagctaaccaggcggccgtgctgatggggctgggcaagggctggcccttgcaccgcatggacctgggggtgcccctgctcgccatggggtgctacagccaagttaaccctaccaccctgacagcgtcgttagtgatgctcctggtccactacgccatcatcgggccgggcctacaggctaaagccacgcgggaggcgcagaagcgcaccgcagcgggcatcatgaagaacccaacggtcgacggtataactgtcatagacctcgagcccatcagctacgaccccaagttcgagaaacagctgggccaggttatgctgctcgtcctgtgcgccgggcagctgctcttaatgcggacgacatgggccttttgcgaggtgttaactctcgcgaccggcccgatcctgacgctgtgggaggggaaccctggccgcttctggaacaccaccatcgccgtgtccaccgccaacatctttcggggtagctatttagccggggccggcctggcgtttagcctcatcaagaacgcccaaactccccggcgtgggaccggcaccgccggggagacgctcggggagaagtggaagcgccagctgaactcgctggaccggaaggagttcgaagagtataagcgctccggtatcctcgaggtcgatcggacggaggccaagtcggccttgaaagatgggtccaaaatcaagcatgcggtgtcccgcgggtccagcaagatacggtggatcgtggagcgcgggatggtcaaacccaagggcaaggtcgtggacctggggtgcggccgcggcgggtggtcctactacatggccacccttaagaacgtcaccgaggtcaagggatacaccaagggcggaccgggacacgaggagcccattcccatggccacctatggctggaacctggtcaagctgcacagcggagtcgacgtgttctacaagcccacggagcaggtcgacacactcctgtgcgacatcggcgagagctcctcgaacccgaccatcgaggagggccggaccctgagagtcctcaagatggtggagccctggctctcaagcaagcccgagttctgtatcaaagtcttgaacccctacatgccgacggttatcgaggagttggagaagctccagcggaaacatgggggcaatttggtgaggtgccccttgtccagaaacagcacccacgagatgtactgggtgtccggcgccagcgggaatatcgtgtccagcgtgaacaccacgtccaagatgctcctgaaccgcttcacgacccggcatcgcaagcccacctacgagaaggacgtcgacctgggcgcagggacacggagcgtgtccacggagatagagaagcccgacatgaccatcattggccgccggctccagcgcctgcaggaggaacacaaggagacctggcactacgaccaggaaaacccttaccggacgtgggcctatcacggtagctacgaggccccctcgactggctctgcctccagcatggtgaacggagtcgtcaagttgctcaccaaaccttgggacgtgatacccatggtcacccaactggccatgaccgacacgacccccttcgggcagcaacgggtgttcaaggagaaagtggataccaggacgccccagcccaaaccgggcacgcgcatggtcatgaccacaacagcgaactggctgtgggccctattaggaaagaagaaaaaccccaggctgtgcacgagagaggagttcatctccaaggttaggtcaaacgccgccatcggtgctgtgttccaggaggagcaagggtggaccagcgcgtccgaggcagtcaacgacagcagattttgggagctcgtggacaaggagcgggccctccatcaggagggcaaatgcgagtcctgcgtgtacaacatgatgggcaagagagagaagaaacttggggagttcggtcgcgccaaagggagccgggccatatggtacatgtggctgggcgcccggttcctcgagttcgaggccctggggtttctcaacgaggaccactggttcggccgggaaaactcctggagcggcgttgagggggagggcctgcaccgcctggggtacatcctcgaggagattgacaagaaggatggcgacctgatgtacgctgacgacaccgccgggtgggacactcggatcacggaggacgacctgcaaaacgaggaactcatcaccgagcaaatggcgccccaccacaagatcctggcgaaggccatattcaagctgacctaccagaacaaggtggtgaaggtccttcgccccaccccgcgaggggcggtaatggacatcatctcccgcaaggaccagcgggggtctggccaagtcggcacctacggtctgaacactttcaccaacatggaggtccaactgatccgccagatggaggctgagggcgtgatcacccaggacgacatgcagaaccccaagggcctcaaggagcgggtggagaagtggcttcgcgagtgcggggtcgaccggctaaagcgcatggcaatctccggcgacgactgcgtggtgaaaccactcgacgagcggttcggtaccagtctgctgttcctaaacgacatgggaaaggtccgcaaggacatcccacagtgggagccgagcaaagggtggaagaactggcaggaggtgcccttttgctcccaccacttccacaagatcttcatgaaggacggacgctccctggttgtgccctgccgcaatcaggacgagctgattggcagagcgcgcatcagccagggggccggatggagcttaagagaaacggcgtgcctgggtaaggcctacgctcagatgtggagcctgatgtacttccaccggcgcgacctcagacttgcctccatggccatatgcagcgcagtgcctaccgagtggttcccgaccagccgcaccacgtggagcatacacgcccaccatcagtggatgaccacagaggatatgcttaaggtgtggaaccgggtctggatcgaggacaaccccaacatgatcgacaaaacccctgtacactcttgggaggacattccctatctcggcaagcgcgaagacttatggtgtggatcccttatcggcctcagctcccgggcgacgtgggccaagaacatccacaccgccatcactcaggtgcgcaacctgatcggcaaggaggagtacgtcgactacatgagcgtgatgaagcggtattccgcgccgtcagagtccgagggggtgctgtga

SEQ ID NO: 26312 - RNA, 9867 nt, synthetic construct
  misc_feature 1..9867: note = derived and/or modified CDS sequence (opt11) from DENV-4__KJ579240__SS-prME
  source 1..9867: mol_type = other RNA
tctaccatcaccctgctctgtctgatccccacggtcatggctttccacctaagcaccagagacggcgagccgctcatgatagtcgcaaaacatgagagggggcgacccctactgttcaagacaacggagggtatcaataagtgcacgctgattgccatggatctcggggaaatgtgcgaggacaccgttacttacaaatgcccactgctcgtgaacaccgagcccgaagacatcgactgttggtgcaacctgacttccacctgggtcatgtacggcacttgcacccagtccggggagagaagacgtgaaaagcgaagcgtggccctgacgccccactccggcatgggccttgagaccagggccgagacctggatgagtagcgagggggcatggaagcacgcgcagagagtcgagtcgtggattctgcgcaaccccggtttcgctctcctcgctgggtttatggcctacatgataggccagaccgggatccagagaacggtcttcttcgtgttaatgatgttggtggcccctagctatggcatgcggtgcgtcggcgtggggaaccgcgacttcgtggagggtgtcagcgggggcgcgtgggtggacctcgtgctggaacatggcgggtgcgtgaccactatggcccagggcaagccaacactggactttgagctcacaaagaccaccgccaaggaggtggccctcctgagaacctattgcatcgaggctctcatctccaacatcacgactgcaacccgctgccccacccaaggggagccctaccttaaggaggaacaggaccagcagtacatctgtcggcgagacgttgtcgaccgaggctgggggaacggctgtggcctgttcgggaagggcggggtggtcacgtgcgcaaagtttagctgttccggcaagatcactggtaacctcgtccagatcgagaacctagagtacaccgttgttgtaaccgtacataatggcgacacgcatgcggtcggcaatgacaccagcaaccatggggtgaccgccacaatcacgccccgcagcccgagcgtggaggtaaagttaccggactacggcgagctcaccctggactgtgaaccccggtccgggatcgattttaacgagatgatcctgatgaagatgaagaagaaaacctggctcgtacacaagcaatggttcctcgacctgccccttccctggaccactggcgccgacacaagcgaagtacactggaactataaggaacgcatggtaaccttcaaagtgccgcacgcgaagcggcaagacgtgaccgtcctggggagtcaagagggagccatgcacagcgccctggcaggcgccacagaagtggacagcggggatgggaaccacatgttcgcgggacacctcaagtgcaaggtgcgcatggagaagctgcgcatcaaaggaatgtcgtacacgatgtgtagcggtaaattctctatcgataaggagatggccgagacccaacacgggacgacagtcgtgaaggtgaagtatgaaggagctggcgccccctgcaaggtcccaatagagatacgggatgtaaacaaagagaaagtggtgggacgagtaatatcggccacgcccctggcggagaataccaactcggtaacaaatatcgagctcgagccgccctttggggacagctacatcgtcatcggcgtgggcaactcagccttgaccctgcactggttccgaaaagggtcctctatcggcaagatgtttgaaagcacgtatagaggcgccaagcggatggccatcctcggcgagaccgcgtgggatttcgggtccgtgggcgggctgttcactagcctggggaaagcggtccaccaggtgttcggctccgtgtacaccacgatgttcggcggtgtcagttggatgatcaggatcttgatcgggttcttagttctatggattggcaccaactcccggaacaccagcatggcggtgacctgcatcgccgtcggcgggattacgctgtttctaggctttaccgtgcaggccgacatggggtgtgttgtcagctggagcggccgcgagctgaagtgcgggagtgggatatttgtggtcgacaatgtccacacctggacggaacaatacaagttccaaccggagagccccgctcggctggcctcagccatcctcaacgcccacaaggacggcgtgtgcgggatccgctccacgactcggctagagaacgtgatgtggaaacagatcactaacgagttaaactacgtcctctgggagggcgggcatgacctaaccgtggttgccggcgacgtcaaaggcgtactgacgaagggtaagcgagcgttgaccccgcccgctagcgatcttaagtactcatggaagacctggggtaaggccaagatcttcactccagaggccaggaactctacctttctgatcgacgggcccgatacttccgagtgcccgaacgagaggcgggcatggaatagcttcgaggtggaggactacggtttcgggatgttcaccacgaacatctggatgaagttccgagagggttccagcgaagtctgcgaccaccggctcatgtccgcagccatcaaggaccaaaaggccgtgcacgcagacatggggtactggattgagagctccaagaaccagacgtggcaaatcgaacgtgcgtccctgatcgaggtgaagacgtgcttatggcctaagacacataccttgtggtccaatggtgtcctggagtcccagatgctgatacccaagtcctacgccgggcctttcagccagcacaactatcggcaggggtacgccacccagacggtgggcccttggcacttaggcaagctggagatcgacttcggcgagtgcccgggaacgaccgtgactatacaggaaaattgcgatcaccgcgggccctccctgcgcacaaccaccgccagcggcaagctcgtcacgcagtggtgctgtcggagctgcacgatgcctcccttgaggtttctgggggaggacggctgctggtatggcatggagattaggccactctccgagaaggaggagaacatggtcaagagccaggttaccgccggccagggcacgtccgagacctttagcatgggcctgctctgcctcacgttattcgtggaggagtgcctgcgccggagagtgactcggaagcacatgatcctcgcggtcgtcataacgctgtgtgccattatattaggcggcctcacctggatggaccttttacgagccctcataatgctgggggacacgatgtccggacggatcgggggccaaacccacttagccatcatcgccgtgttcaagatgagccccggatacgtcctcggcgtgttcttgcgcaaactgacctcccgggagaccgcgctcatggtgatagggatggcgatgacgaccaccctgtcgatcccccacgatctgatggagctcatagacggcatctcacttggcctgatcttattgaagatcgtcacccagttcgacaacacgcaggtaggtaccttagcccttagtctgaccttcatcaggtccacaatgtcccttgtaatggcgtggagaaccataatggccgtcctctttgtcgtgaccctgatcccgctgtgtcggacctcctgtctccagaaacagagccactgggtcgagatcactgctttgatcttaggcgcccaggccctccctgtgtacctgatgacgctgatgaagggagcctctcggcgcagctggccccttaatgagggcatcatggcggtcggattggtgtccctactcggatcagccttattgaagaacgacgtgccgttggccggaccgatggtggcagggggcctcctgctcgccgcctacgtcatgtccgggagcagcgccgatctgtcactggagaaggccgccaacgtgcagtgggacgaaatggccgatatcaccggcagctcccccatcatagaggtaaagcaagacgaggacgggtcattctccatccgcgacgtagaggaaaccaatatgatcacactcctggttaagctggcgctcatcacggtgtcgggcctgtacccactggccataccgatcaccatgaccctctggtacatgtggcaggtcaagacccagcgcagcggcgccctgtgggacgtcccctcacccgctgccacccagaaggccgcactgtccgagggggtgtaccggatcatgcagcgcggcctcttcgggaagacacaggttggcgtagggatccacatggagggcgttttccacaccatgtggcacgtaacccgaggcagcgttatctgtcacgagaccgggcgcctggaaccctcctgggcggacgtgaggaacgacatgataagttacggcgggggatggcggttgggtgacaaatgggacaaagaggaggacgtccaagtgctcgccatcgagccgggtaagaaccccaaacatgtgcaaaccaagcccggcctgttcaaaaccttaaccggggaaatcggtgccgtcacgctcgacttcaagcccgggacgtccggtagcccgatcattaaccgtaaaggaaaggttatcggactgtatggaaatggggtggtaaccaagtcgggcgactatgtgagcgctataacccaagccgagcggatcggagaacctgactacgaggtggacgaagatatattccgtaaaaagcgtctgaccatcatggatctccatcccggcgcaggcaagacgaagcgcatcctgccgtcaatcgtccgggaagcccttaagcgtcgactccgcactctcatcctggcgcccacccgggtagtggcggccgagatggaggaggccctgcgcgggcttccaattaggtaccaaacgcccgccgtcaagagcgagcatacgggccgcgagatcgtggacctgatgtgccacgccaccttcaccacccggctcctatccagcactcgagtgcctaactacaacttgatcgtcatggacgaggcacacttcaccgacccttcgtccgtggcggcccgagggtatatcagcaccagagtcgagatgggggaggccgccgctatcttcatgaccgccacgcccccgggagctacagacccgttcccgcagtccaacagccccatagaggacatcgaaagggagatccccgagcgctcgtggaacaccggcttcgattggatcaccgattatcagggcaagacggtgtggttcgtgccgtctatcaaggccgggaatgatatcgctaactgcttacgcaagtccggcaagaaggtgatccagctcagccggaagaccttcgacaccgagtatcccaagacgaagctgacggactgggacttcgtggtgaccacggacatttccgagatgggggccaacttccgcgccggccgggtcatagacccaaggcggtgcctaaagcccgtgatcctcacagatgggcctgagagagttatactagctggcccgatccccgtcacgcccgcgagcgccgcccagcgacgaggcaggatagggcgcaacccggcacaggaggatgaccagtacgtgttctccggcgaccccctgaagaacgatgaggatcacgcccattggaccgaagcgaagatgctcctggataacatatacacacccgagggtatcatacccaccctgttcggcccggaacgggagaagacccaggccatcgacggcgagttccgcttacgtggggagcaacgcaagaccttcgtcgagttgatgcggaggggcgacttaccagtatggttgagctacaaggtggcctccgcgggcatcagttataaagacagagagtggtgcttcaccggcgagaggaacaatcaaatcctggaagaaaacatggaggtggagatctggaccagggagggtgagaagaagaagcttcgcccgaagtggctcgacgcccgggtctacgctgaccccatggccctgaaggatttcaaggagttcgcctccggtagaaagagcatcaccttggatatcctcaccgagatcgcctcgctaccgacctacctgagcagcagagcgaagctcgcgctggacaacatcgtgatgctacacaccacggaacggggcgggcgcgcctaccagcacgccctcaatgagctgcccgagagcttggaaaccctcatgctcgtggcccttctgggcgccatgaccgccgggatcttcctcttctttatgcaggggaaggggatcggcaagctgagcatgggcctgattacgattgccgtcgccagcgggctgctgtgggtagccgagatccaaccccagtggatcgcggcaagcatcatcctggagttcttcctgatggtgctgctcatcccggaacccgagaaacagcgcaccccccaggataatcagctgatctatgtcatcctgaccatcctaacaatcattggcctgatcgccgcgaacgagatggggctgatcgaaaagacaaaaaccgactttggtttttatcaggtgaagacggagaccaccatccttgacgtggacctgcgcccggcctccgcttggaccctgtacgcggtggccacgaccatactcacaccgatgctgcggcacacgatcgagaacaccagcgccaacctgtccctcgccgccatcgccaaccaagctgccgtactcatgggattgggcaagggctggcccctccaccgcatggacctgggggtgcccctgctcgccatgggttgctactcgcaggtcaaccctacgaccctgactgcgtccctggtgatgctcctggtccactacgcgattatcgggcctggcctgcaggccaaggccacaagagaggcgcagaagcgtaccgccgccggtatcatgaagaaccccaccgtcgacggtataacggtgatcgatcttgaacccatcagctatgaccccaagttcgagaagcaactcggccaggtaatgcttctcgttctatgcgcgggacagctgctcctaatgcggactacctgggctttctgcgaggtgctgaccctcgcgaccggccctattctgacgctgtgggaagggaaccccggccgcttctggaacaccacgatcgccgtgtccacggccaacatctttcgggggagctacctcgccggggccggacttgcgttctcccttatcaaaaacgcccagacgccacgccgggggaccggcacagccggggaaaccctcggcgagaagtggaagagacagctgaacagtctggaccggaaggagttcgaagaatacaagagatccgggatcctcgaggtcgaccggaccgaggcgaagagcgcccttaaagacgggtcgaagataaagcacgctgtctctaggggatcatcgaagatccggtggatcgtggagcggggcatggtcaagcccaaggggaaagtggtggacctgggatgcggcaggggcggatggtcctattacatggccacgctaaagaatgtaaccgaggttaagggctacaccaaggggggtccggggcacgaagagccgatcccgatggccacctatggctggaatctggtgaaactgcacagtggcgtcgacgtgttctataagcccacagagcaggtggacaccctcctgtgcgacatcggggagagctcgagcaatccgaccatcgaggaaggccggacccttagggtcctcaaaatggtagagccgtggctgtctagcaaacccgagttctgcataaaggtcctgaacccatacatgccgaccgtcattgaagagttggagaagctccagcggaagcatgggggcaacctggtgaggtgcccgttatctcggaacagcacgcacgaaatgtactgggtcagcggtgcaagcggaaacatcgtgtccagcgtaaacaccacctccaaaatgctcctaaaccgcttcaccacccgccacagaaaacccacctatgagaaagacgtcgacctgggggcaggtaccagaagcgtatccacggagatcgaaaagcccgacatgaccatcatcggccgccggttgcagcgcctgcaggaggaacacaaggagacatggcactacgaccaggaaaatccgtaccggacgtgggcctaccatggaagctacgaggctccatcaactggcagcgcctccagcatggttaacggcgtcgtgaagctgctgaccaagccatgggacgtgattccgatggttacccaactggcgatgacggacacgaccccgttcgggcagcagcgcgtgttcaaggagaaggttgacacccggaccccccagcctaagccgggcacgcgtatggtcatgacaaccaccgcgaactggctatgggcactcctgggtaagaagaaaaacccccgtctgtgcacgcgcgaggagttcatcagtaaggtgcggagcaacgccgccataggcgctgtgttccaggaggagcagggttggacctcagcgtccgaagccgtcaatgatagccgcttttgggagcttgtagataaagagcgggcactgcaccaggagggcaagtgcgagtcctgtgtctacaacatgatgggtaagcgcgagaagaagctgggggagtttggccgtgccaaggggtcacgagccatctggtacatgtggttaggcgctcgcttccttgagttcgaggccctcgggttcctcaacgaagatcattggttcgggcgagagaactcctggagtggggtcgagggcgagggcttacaccgcttagggtatatcttagaggaaatcgacaagaaggacggtgacctaatgtatgccgacgacactgcaggctgggacacaagaatcaccgaggacgacttgcagaacgaggagctcatcaccgagcagatggcaccccaccacaagatcctggccaaggccatcttcaaactgacataccaaaacaaagtggtaaaggtcctcaggccgactccgcggggggccgtcatggacataatctcacgaaaggaccaacggggcagcgggcaagtgggcacctatggtctgaacactttcaccaatatggaggtgcaactgataagacagatggaggccgagggagtgatcacccaggacgacatgcagaaccctaagggtctcaaggagcgggtagagaagtggctgagagagtgcggggtcgaccggctgaaacgaatggcgatctccggggacgactgtgtggtcaagcctctggacgagagattcgggaccagcctcctgttcctcaacgacatgggtaaggtccgaaaggacatcccccagtgggagccgtccaagggttggaaaaactggcaggaagtacctttctgcagccaccactttcataagatctttatgaaggatgggcggtccctggtggtcccctgccgcaaccaagatgagctcatcggccgggcccgaatatcacaaggggccgggtggagtctccgcgagacggcctgcctggggaaagcctacgcgcagatgtggagcctgatgtacttccaccggcgtgaccttcgactggcctccatggccatctgcagcgccgtgcccacggaatggttccccacatctcgcaccacgtggtccatccatgcccaccaccagtggatgaccactgaggacatgctaaaggtttggaacagggtgtggattgaggacaaccccaacatgatcgataagactccagtgcacagctgggaggatatcccatatcttggcaagcgcgaggacctgtggtgcggctccttaattggcctcagctcccgggcgacatgggccaagaatattcatactgccatcacccaggtacgcaacttgatcggcaaggaggagtatgtcgactacatgagtgtgatgaagcggtactcagccccgagtgagtccgagggggtcctgtga

SEQ ID NO: 26313 - RNA, 9867 nt, synthetic construct
  misc_feature 1..9867: note = derived and/or modified CDS sequence (opt11) from DENV-4__KJ596658__SS-prME
  source 1..9867: mol_type = other RNA
agcaccatcacgctgctatgcctgatacctaccgtgatggctttccatttgagcacccgcgacggcgaaccgctcatgatcgtagccaagcacgaacgggggcgccccctactctttaaaaccaccgaaggcatcaacaaatgcactctgatcgcgatggacctgggggaaatgtgcgaggacaccgtgacctataagtgcccactcctagtgaacaccgagcccgaggatatcgactgctggtgcaatctcacgtcaacctgggtcatgtacggaacctgcacccagagtggggagcggcgccgggaaaagcgcagcgttgccctgactccgcactcgggcatgggcctcgagacgcgggcagagacctggatgagttctgagggggcctggaagcacgcccagcgagtcgaaagttggatcttgcgcaacccgggcttcgcgctgttggctggtttcatggcctacatgatcggccagaccgggatccagaggacggtcttcttcgtgctaatgatgctagtcgccccctcctacggcatgcggtgtgtcggcgttgggaaccgcgatttcgttgagggcgtttccgggggcgcttgggtagacctcgtgctggagcacggcgggtgtgtgaccaccatggcccagggcaagcccacccttgacttcgagttaacgaagaccaccgccaaggaagtcgccctcctgcggacgtattgtatcgaagccttgatttccaatattactaccgcgacccgctgcccaacccagggggagccctacctaaaggaagaacaagatcaacaatacatatgtagacgcgacgtggtcgaccggggatgggggaatggctgcggcctgttcgggaagggcggggtggttacatgtgctaaattctcttgctccggcaaaatcaccgggaatcttgtacaaatcgaaaatttagagtacacagttgtggtgaccgtacacaatggcgacactcacgccgtcgggaacgacacaagcaaccacggcgttactgccacgatcacgccccgcagccccagcgtggaggtcaagctcccagactacggtgagctcaccttggactgcgagcccaggtccgggatcgacttcaacgaaatgatcctgatgaagatgaaaaagaagacctggctggtgcacaaacaatggttcctggacctgcccctcccctggaccaccggcgctgacactagcgaggtgcactggaactataaggaacggatggttacctttaaggtaccgcatgcgaagcgccaggacgtgaccgtccttggcagccaggagggcgccatgcattccgccttagcgggcgccacggaagtggactcgggggatggcaaccacatgttcgcggggcacttaaaatgcaaggtccgcatggaaaagctccgaatcaagggcatgagttacaccatgtgtagcggcaagttcagcatagacaaggaaatggccgagacacagcacggtacgaccgtcgtaaaggtcaagtacgaaggcgcgggggccccgtgcaaggtccccatcgagatccgggatgtgaacaaagagaaagtggtcggccgcgtcattagcgctacgcccctggcggagaacacaaattccgtgactaacattgagctagagccgcccttcggggatagttatatcgttatcggtgtgggcaacagcgcactaaccctccactggttcaggaaaggcagctccattggtaagatgttcgagagcacgtaccgcggggcgaaacgcatggctatcctgggcgaaacagcctgggactttgggtccgtagggggcctgttcaccagcctgggcaaggccgtacaccaggtgttcggcagcgtatacaccacgatgttcgggggagtctcgtggatgatccggattctcatcggcttcctagtgctgtggattggcaccaatagccggaacacttcaatggctatgacctgcatagctgtcggcgggatcacgctgttcctcggcttcaccgtgcaggccgatatggggtgcgtagtgtcatggagcggtcgggaactgaagtgcggttctggcatctttgttgtggacaacgtgcatacatggaccgaacagtacaagttccagcccgagagcccagcccggctggctagcgccatactcaatgcccataaggacggggtctgtgggattagaagcacgactcggttggagaacgtaatgtggaaacagattaccaacgaactgaactacgttttatgggaaggcggacatgacctcaccgtcgtggccggagatgttaaaggggtcttaaccaaagggaaacgcgctctcaccccgccggccagtgacctgaagtattcatggaagacctgggggaaggcgaaaatcttcaccccggaagcccgtaactccacgtttctgatcgacgggccagacaccagcgagtgtccaaatgagcgccgggcctggaacagcttcgaggtggaggactatggcttcgggatgttcacaacgaacatatggatgaagttccgcgagggttccagcgaggtctgcgatcaccgcttaatgtccgcagcgataaaagaccaaaaggccgtgcatgccgacatgggctactggatagagtcgagtaaaaaccagacctggcagatagagcgcgcgtctctaatcgaggtaaagacatgcctttggcccaaaacgcacacactctggtccaacggggtgctggagagccaaatgctgatcccgaagtcctacgccggccccttttcacagcacaactaccgacaggggtacgccacccaaacggtagggccctggcacctcggcaaacttgagatcgattttggcgagtgtccgggcaccaccgtcaccatccaggaaaattgcgaccatcgcgggccctccctcaggaccaccaccgcctcaggcaagctcgttacccagtggtgttgccggagttgcacaatgccgcccctgcggttcctcggggaggatggctgctggtacggtatggagatccggcccctctccgagaaggaggagaacatggttaagagccaggtgacagccggccaaggaacctccgagaccttcagcatggggctgctgtgccttacgctattcgtcgaggagtgcctgcgccggcgcgtgaccagaaaacatatgatcctcgctgtggtcatcaccctatgcgcaatcatcctgggtgggctcacatggatggacttactgcgtgccctcattatcctgggggatacgatgtccggccggataggaggccagacacatttagccattatggccgtgttcaaaatgtccccggggtatgtcttaggggtattcctacgcaagttgacatcacgggagacagcattaatggtgatcggaatggcaatgacgaccacgttgtcgatcccgcacgacctgatggagctcattgacggtataagcctgggcctgatcctactgaagatcgtaacccagttcgacaatacgcaggttggtaccctcgccctcagcttaacctttatacgctctaccatgagtctggtgatggcttggcggacgatcatggccgtgctattcgtggtgacactgatcccgctttgccgtacctcctgtttgcaaaaacagagccactgggtggaaatcacggcgctgatcctgggggcacaggccctccccgtttatttgatgacgctgatgaagggagcatcacggagaagctggcccctcaacgagggaatcatggccgtggggctggtgagcttattaggttcggcgttgttgaagaacgacgtcccgctcgccgggcccatggtggcagggggactgctattggcggcgtacgtgatgtctgggagcagcgccgacttaagcctggagaaggccgctaacgtacagtgggacgagatggccgatattacgggaagctccccgatcattgaggtgaagcaggacgaagacgggagcttttcaatacgggatgtagaggaaaccaacatgattacgctcttagtcaagctggcgctcataacggtaagcggtctgtatccactggccatcccaatcaccatgaccctctggtacatgtggcaagtgaagacgcagcgtagcggcgctctgtgggacgtcccttcaccagcggccacccagaaggcggccctatccgagggagtataccggatcatgcagcgcggcctcttcgggaagacacaggttggcgtcggaatccatatggaaggtgtgttccatacaatgtggcacgttacccggggctctgtcatatgccacgagaccggtcgacttgagccgtcctgggcagacgtgcgcaacgatatgatttcatatggagggggctggcggctgggcgacaagtgggacaaagaagaagacgtgcaggtcctcgccatcgagcctggtaagaaccccaaacacgtgcaaacgaagcccgggctgttcaagacgctcaccggggagataggggccgttacactagactttaagcccgggacctccggtagcccgataattaaccggaaaggtaaggtcataggattgtatggaaacggggtggtgactaagtccggagattacgtgagcgctatcacacaggccgagcgtatcggcgagcccgactatgaggtggacgaggacatcttcagaaagaaacggttaaccataatggatctccacccgggtgccggcaagacgaaacgcatactgccgtccatcgtgcgggaagcattgaagcgacggctgcgtacgctcatcctggcgccgacccgggtggtggccgcagagatggaggaggcactacgcggacttcccatccgttaccagacccccgccgtcaagagcgagcataccggccgggaaatcgtggacctcatgtgccatgcgactttcacaacccgcctgctctcaagtactcgggtgcccaactacaacctgatcgtgatggacgaggcccattttaccgaccccagcagtgtggcagccagaggttacatcagcaccagggtggaaatgggcgaagcggcggccattttcatgaccgcgacgcccccgggggcaacagaccccttcccccagagcaactcgcccatcgaagacattgagcgggagatccccgagcgcagctggaacaccggcttcgactggatcacggactaccagggcaagacagtatggtttgtaccgagcatcaaagccggcaacgacatcgccaattgcctgcgcaaatccggcaagaaggtgattcagctctcgcggaagaccttcgacaccgagtatcccaagactaagctgacggactgggacttcgtggtgaccacggacatctccgagatgggggccaacttccgcgccggccgggttatcgaccctcgccggtgcctcaagcctgtcattttgacggacggtcctgagcgcgtaattctggccggcccaataccggtgacacccgctagtgccgcccaacggcgagggcgaatcgggagaaatccggcacaggaggacgaccagtatgtattctccggcgaccccctgaaaaacgacgaggatcacgcccactggacggaggccaaaatgctgctggacaacatctacacccccgagggtatcatccccaccctgttcggcccggagcgggagaaaactcaagccattgatggcgagttccgactcagaggggaacagcggaagaccttcgttgagctgatgcgacgcggcgacctgcccgtttggctcagctataaggtcgcgtccgccggaatatcatataaggacagggagtggtgtttcacaggcgagcgcaacaaccagatcctggaagaaaatatggaggtggagatttggacccgggaaggggagaagaagaagctacggcccaaatggctcgacgcccgtgtatatgcggaccccatggccttgaaggacttcaaggagttcgcctccggccgaaagtccatcacccttgacatcctcacggaaatagcctccctgccaacgtacctcagctcccgcgccaagctcgccttagacaatattgttatgctacacaccaccgagagaggagggcgcgcctaccagcacgctttaaacgagctgcctgagtccctggagacactaatgctggtggcactgctcggtgcgatgactgctggcatcttcctgtttttcatgcagggcaaaggtataggcaagctgtcgatgggactcataaccatcgccgttgcctctggtctgttatgggtggcggagatccagccccagtggatagccgcgtccatcattttggagttctttctgatggtactgctaattccggagcccgaaaagcagcggacaccccaggacaaccagctcatatacgtgatcctgaccattctcacgataatcggcctaatcgctgccaatgagatgggcctaatagagaagactaagacagactttggcttctaccaggtgaagactgaaactaccatcttagacgtggacctccggcccgcctccgcatggacactgtatgccgtcgccacgaccattctcacgcccatgctgcggcacaccatcgagaatacgagcgccaacctttccctcgccgcaatcgcaaaccaggccgcggtgctgatgggtttaggaaaaggttggcccttgcataggatggacctaggagtccccctgctggccatgggctgctatagccaggtgaaccctaccactctcaccgccagccttgtcatgctcctggtgcactacgcgataataggccccggtctgcaggccaaggccacgagagaggctcagaagcgcactgctgccggtatcatgaagaaccctaccgtggacggcatcactgtcatcgacttagaacccatctcttatgaccccaagtttgagaagcagttaggacaggtgatgctgctcgtgctgtgtgccgggcaattactcctgatgcgtacgacctgggccttttgcgaggtcctgacactggcgactggtcctatcctgacgctgtgggagggtaatcctggtcgcttttggaacaccacgatagccgtgtccacagcaaatatcttccggggtagctacctggcaggggccgggctagctttcagtctgatcaaaaacgcccagacaccccggcgggggacagggacggccggggagaccttaggtgagaagtggaagcgccagctcaactctctggaccgcaaggagtttgaggaatacaagcgctcggggatcctcgaggttgaccggaccgaggccaagtcggccttgaaggatgggtccaaaattaaacatgcggtatctcgcggcagctcgaagatcaggtggatcgtggaacgggggatggtgaagccgaaggggaaggtcgtagacttaggatgcggccgaggcgggtggtcctactacatggccacgcttaaaaacgttaccgaagtcaagggctacaccaaaggtgggcccgggcatgaggagccgatacctatggcaacctacgggtggaacctggtaaaattgcattccggggtggacgtcttctacaagcccacagaacaggtggacacactactctgtgacattggggagtctagctccaacccgacaatcgaggagggccggacccttcgcgtactaaagatggtcgaaccatggctctcgagcaagcccgagttctgcatcaaagtgctgaacccgtacatgccgacagtgatcgaggagctggaaaaattacagaggaagcacgggggcaatctagtcaggtgccccttgtcccggaacagcacacatgagatgtactgggtcagcggagcttccgggaacatcgtctccagcgtaaacaccacaagtaagatgctcttgaaccggtttacgacccggcaccgcaaacctacttacgaaaaagacgtggaccttggcgcgggcacccggagcgtatccacggagaccgaaaagcccgacatgaccataattggcaggcggctccagcgcctgcaggaagaacataaggagacctggcattacgaccaggagaatccttacagaacgtgggcttaccatgggtcgtacgaagcaccgtcgactggcagcgcttcatccatggtgaacggcgtggtgaagttactcaccaagccctgggacgtgatcccgatggtgacccagctggccatgactgataccaccccctttggacagcaacgcgtctttaaggagaaagtggacacacggacgccacagcccaagccgggcacccggatggtgatgacgactacggcgaattggctgtgggctctcctcgggaagaagaagaacccccggctgtgtaccagggaagagttcatctccaaagtccgttcaaacgccgcaatcggcgccgtgttccaagaggagcagggttggacctctgcgagtgaggcggtgaacgacagtcgcttttgggaattagtcgacaaggagcgggccctccatcaggagggcaagtgcgaatcttgcgtgtacaacatgatgggtaagcgtgagaagaagctgggcgagtttggccgcgccaaggggagtcgggccatctggtacatgtggctaggcgcacgttttctagagtttgaggccctcggattcttaaacgaggatcactggttcggtcgggagaactcatggagcggtgtggagggggagggcctacaccgcctggggtacatcctcgaggaaatagacaagaaagatggcgacctgatgtacgcggacgacaccgccggatgggacacccggataaccgaggatgacctgcagaacgaggaactgatcacggagcagatggctccccatcacaagattttggccaaggcaatcttcaagctcacttatcagaacaaggtcgtgaaagtcctccggcccacaccccgaggtgctgtcatggacataatatccaggaaggatcagcgaggcagcggtcaagtgggcacttatgggctgaacacattcacgaacatggaggtgcagctgatccgtcagatggaggccgaaggggtcattacccaggacgacatgcaaaatcccaagggcctcaaagagcgggtggagaaatggctgcgggaatgcggggtggaccgtctgaagcgcatggccatctccggtgacgactgcgtggtaaagcccctcgacgaaagattcgggacgagcctgctgttcctcaacgacatgggcaaggttagaaaagacatcccccaatgggaaccatccaaagggtggaagaactggcaggaggtacccttttgcagccatcacttccacaaaatcttcatgaaagacggccgatccctcgtcgtcccctgtcgcaaccaggacgaactgatcggccgtgccaggattagccagggggcgggctggtccctcagagagaccgcttgcctgggtaaagcatatgctcagatgtggagcctcatgtacttccaccgtcgcgaccttcggctcgcatccatggccatctgcagcgctgtccccaccgaatggttcccgactagccggacgacctggagtattcatgctcaccaccagtggatgacgaccgaggacatgctcaaggtgtggaaccgtgtgtggatagaggataacccgaatatgatagataagacaccggtccactcgtgggaggatatcccctacctcggcaagcgcgaggatctgtggtgcggttccttgatcggcttgagctctcgggcgacctgggccaagaatatccacactgccattacccaggtacgcaacctgatcggcaaggaggagtatgtggactacatgccggtcatgaagcgttattcagccccgtcagagagcgagggggtgctttag

SEQ ID NO: 26314 - RNA, 9867 nt, synthetic construct
  misc_feature 1..9867: note = derived and/or modified CDS sequence (opt11) from DENV-4__KJ596659__SS-prME
  source 1..9867: mol_type = other RNA
agcaccattaccctgctctgcctgatccccaccgttatggcgttccacctgtccacccgcgacggcgaaccgttgatgatcgtggcgaaacacgaacgggggcggcccctgctgttcaagacgacagaaggtatcaacaagtgcacgctcatcgcgatggacctgggcgaaatgtgcgaggacaccgttacctataagtgccccttgctcgtgaacaccgagcccgaggacatcgactgctggtgcaacctgacgagcacatgggtcatgtacgggacctgcacccagtccggggagcggcgacgggaaaagcgcagcgtggcactgacgccgcactcaggcatgggcttagagacccgggccgaaacctggatgagctctgagggtgcttggaagcacgcccagcgcgttgagagctggattctgcggaaccccggcttcgcgctgctcgccgggttcatggcttacatgatcggccagaccgggattcagcggacagtcttctttgtgctgatgatgctggtcgctccctcctacggcatgcggtgcgtcggcgttggcaaccgcgacttcgtggagggcgtcagcgggggcgcgtgggttgacctcgtgctggagcacggagggtgcgtcaccaccatggctcagggcaagccgaccctggacttcgagctcacgaaaaccaccgccaaggaggtggccttgctgcggacctactgcatcgaggccctcatttccaatatcaccaccgctacccgctgcccgacccaaggggagccctacctgaaggaggagcaggaccagcaatacatctgccggcgtgacgtggtggacaggggctgggggaatggatgcggcctcttcgggaagggcggggtcgtgacgtgcgcaaagttcagctgctccggcaagatcaccgggaatctggtacagatcgagaacctggagtacaccgtggtggtcaccgtgcacaacggcgacacgcacgctgtgggcaacgacaccagcaaccatggggtgaccgccacaatcacgcccagatctccctccgtggaggttaagctgccggactacggtgagctcaccctggactgtgagcctcggtccgggatcgactttaacgagatgatcctgatgaagatgaagaagaagacctggctcgtgcacaagcagtggtttctggacctgcccctcccctggaccaccggcgcagatacgagcgaggtgcactggaaccacaaggagcgaatggtcaccttcaaagtgccgcacgcgaagcggcaggacgtgacagtcctggggtcccaggagggcgccatgcacagtgccttagcgggcgccacggaggtggacagcggggacggcaaccacatgttcgcggggcatctcaagtgcaaggtgcgcatggagaagctgcgcatcaagggaatgtcctatacgatgtgcagcggcaagttcagcatcgacaaggaaatggccgagacccaacacgggacgaccgtcgttaaagtgaagtacgagggagccggggccccctgcaaagtccccatcgagatccgggacgtaaacaaggagaaggttgtcggccgcgtgataagcgccacgccgctggcggagaacaccaattccgtgaccaacatcgagctcgagccgccctttggggacagctacatcgtcatcggcgtcggcaattccgccctcacgctgcactggttccggaagggaagctccatcggcaagatgttcgagagcacgtaccgcggggctaagcggatggccatcctcggcgaaaccgcgtgggacttcggaagtgtgggcggcctgttcaccagcctggggaaggccgtccaccaggtgttcggttccgtgtacaccacgatgttcggcggcgtcagctggatgatccgcattctcatcgggttcttagtgctgtggataggcaccaattcccggaacaccagcatggcaatgacctgcatcgctgtgggtgggatcacgctgttcctcggcttcaccgtccaggcggacatggggtgcgtggtttcctggagcggcagagaactgaaatgtgggtccggcatcttcgtcgtggacaacgtgcacacctggaccgagcaatacaagttccagcctgaaagccccgcgcggctggccagcgccatcttgaacgcccacaaggacggcgtctgcgggatccgcagtaccacccggcttgagaacgtgatgtggaagcagattaccaacgagctcaattatgtgctttgggagggcgggcacgacctgaccgtcgtggcaggcgatgtgaaaggggtcctcacgaaggggaagcgcgctctcacgccgcccgcctctgacctgaagtactcttggaagacgtggggcaaagccaagatattcacccccgaggcccggaacagcacgttcttgatcgacgggcccgacacctccgagtgcccgaacgagcgccgggcctggaacagcttcgaggtggaagactacggattcgggatgtttaccaccaacatctggatgaagttccgcgagggctccagcgaggtgtgtgaccaccggttgatgtccgcggccatcaaggaccagaaggcggtccatgccgatatgggctactggattgagagcagtaagaaccagacgtggcagatcgagcgcgcgagcctgatagaggtgaagacctgcttatggcccaagacccacaccctatggtccaacggggtgctggagtctcagatgttaatccccaagtcctacgccggtccgttcagccagcacaactacagacaggggtacgcaacccagacggtcggcccctggcacctggggaagttggagatcgactttggcgagtgccccggaaccactgtgaccatacaggagaactgcgaccaccgcgggcccagcctgcgcacgaccaccgccagcggcaagctcgtgacccagtggtgctgccggagctgcacgatgccgcccctgcgcttcctgggagaggatgggtgctggtatgggatggagatacggcctctctccgagaaggaggagaacatggtaaagtctcaggtgactgccggccagggtacatccgagactttcagcatggggctgctgtgcctcacgctgttcgtagaagaatgcctgcgccggagagtcacccggaagcacatgatcctcgcggtcgtcatcaccctgtgtgccatcatcctgggcgggttgacgtggatggatctgctgcgcgcgctcatcatactgggggacacgatgtccggccggatcgggggtcagacccatctggctatcatggccgtcttcaagatgagtcctgggtacgtgctcggggttttcctgcggaagctgacctcccgggaaactgcgctcatggtaatcggaatggccatgactaccaccctgagcatcccgcacgatctgatggagctcatcgacggcatctccctgggcttaattctacttaagatcgtgacccagttcgacaacacgcaggttgggacactggccctcagcctgactttcatacgcagtaccatgagcctggtgatggcctggcggaccatcatggctgtactcttcgtcgtcaccctgatccctctgtgccgcacatcctgcctccagaagcagagccactgggtggaaatcaccgcgctgatattaggcgcccaggccctccccgtctacctgatgacgctgatgaaaggggcctcccggcgctcatggcccctcaacgagggtatcatggcggtggggctggtctccctgctcggcagcgccctgctcaaaaacgatgtcccgctagccggccccatggtggcagggggactgctgctcgccgcgtacgtaatgtccgggagcagcgccgacctgagtctggagaaagcggcgaatgtccagtgggatgaaatggccgatataaccggtagctcccccatcatcgaggtgaagcaggacgaggacgggagcttctccatccgagatgtggaggagacgaacatgatcaccctcctggtcaagctggcgctaatcacggttagcggcctgtaccccctggccatcccgatcaccatgaccctctggtatatgtggcaagtgaagacccagaggtccggcgccctttgggatgtcccgagccccgcagccacccagaaggcggccctgagcgagggggtgtatcggatcatgcagcgcggactcttcgggaagacacaggtgggcgttgggatccacatggaaggcgtcttccacaccatgtggcacgtgacccggggcagtgttatctgtcacgagacagggcgcctggaaccctcatgggccgacgtgaggaacgacatgatcagctacggcgggggctggcggctaggcgacaaatgggataaggaggaggacgtgcaggtcctggctatagagccgggcaagaacccaaaacatgtacagacgaagcccggcctgttcaagaccctgaccggggagattggcgctgtaaccctagacttcaagcccggtacgtccggcagtccgatcataaatcgcaaaggaaaggttataggactgtacggcaacggggtggtgaccaagtccggcgactacgtaagcgcgataacccaggccgagcggatcggggagcccgactacgaggtggacgaggacatcttccggaagaagcggctgaccatcatggacttgcatcccggcgccggcaagacgaagcgcatcctcccgtccatcgtgcgggaggccctgaagcgccggctgcgcaccctcatcctggcgcccacccgggtcgtggccgccgagatggaggaggctctgcgcgggctccccatccggtaccagacccccgccgtaaagagcgagcacacgggccgcgagatcgtcgacctgatgtgccatgctaccttcacgaccaggctgttatccagcacgcgggtgccgaactataacctgattgtgatggacgaagcccacttcaccgatcccagctccgtagcggcccgggggtacatcagcaccagagtcgagatgggcgaggccgcggccatcttcatgaccgctacgccacccggtgccactgaccccttcccccagtccaatagccccatcgaggacatcgagcgggaaataccagagcgctcctggaacaccggcttcgactggatcaccgactaccaagggaagaccgtctggttcgtgccgtcgatcaaagccggcaacgacatcgcgaactgcttgcgcaagtccggcaaaaaggtgatccagctcagccggaaaaccttcgacaccgagtacccaaagaccaaactgacggactgggacttcgtcgtcacaacggacatctctgagatgggggctaacttccgcgcaggccgggtgatcgatccacgccggtgccttaagccggtgattctcacggacgggccggagcgcgtaattctagccggccccatccccgtgacgcccgcgagcgcggcccagaggcgcggccggatagggcggaacccggcacaggaggatgaccagtacgttttctccggcgaccctctgaagaatgacgaggatcacgcccactggaccgaggcgaagatgctcctagacaacatctacacccccgaggggatcatccccacactcttcgggccagagagagagaagacgcaggccatcgatggcgagttccgtttgagaggggagcaacggaagaccttcgtggagctgatgcgtcgcggagatcttccggtgtggctcagctacaaggtcgcctcggccgggatcagctacaaggaccgggagtggtgcttcacaggcgagcgcaacaaccagatccttgaggagaatatggaggtggagatctggacccgggagggagagaagaaaaagctccgccccaagtggctcgacgcccgggtgtacgcggaccccatggccctgaaggacttcaaggagttcgcgtcaggccgcaagtctatcaccctggacatcctcactgaaatcgcctccctgcctacctacctgagctcccgcgccaagctcgcgctggacaacatcgtcatgctgcacaccaccgaacggggaggacgcgcctaccaacacgccctcaacgagttgcccgagtcgctggagacgctcatgctggtggccctgctcggtgcgatgaccgccgggatcttcctgttcttcatgcagggtaagggaatcggcaagctcagcatgggcctcatcacgatcgccgtggccagtgggctcctgtgggtcgccgagatccagccccagtggattgcggccagcatcatcctcgagttcttcctgatggtgctgctcatcccggaacccgagaagcagcggaccccgcaggacaaccagttaatctacgtgattctaacgatactcaccatcatcggcctgatcgccgccaacgagatggggctgatagagaagaccaagactgacttcgggttctaccaggtgaagacggagaccaccatcctcgatgtggacctgcgccccgcctccgcgtggaccctgtatgcggttgctaccaccattcttaccccgatgctgcggcacacgatcgagaacacgtccgctaacctttccctcgcagcgatcgccaatcaggccgccgttctgatggggctgggcaaaggctggcccctccaccgcatggacctaggcgtgcccctgctcgccatggggtgctatagccaggtgaaccccacaacccttaccgcttccctggtcatgctcctggtgcattacgctatcataggtccgggcctccaggccaaagcgactagagaggcgcagaagcgcaccgccgccggcattatgaagaacccaaccgtggacgggatcaccgttatcgaccttgagcctattagctacgaccccaagtttgagaagcagctgggccaggtgatgctgctcgtgctttgcgcagggcagctgctcttgatgcggacgacctgggccttctgtgaagtcttaacgctggcgaccggcccgattctgacgctgtgggaggggaaccccggccgcttctggaacaccaccattgccgtctccaccgcgaacatcttccgggggagctacctcgccggggctggcctggccttcagcctgatcaagaacgcacagacgcctcgccggggaaccggcaccgccggggagactctcggcgagaagtggaagcgccagctgaacagcctggaccggaaggagttcgaggagtacaaacgctctggcatcctagaagtagaccggaccgaggcaaagagcgccttaaaagacgggtccaagataaagcatgcggttagccgcggctcctctaaaatccggtggatagttgaacgcgggatggtgaaacccaagggcaaggtcgtggacctgggatgcgggcgcggcgggtggtcctactatatggccactctcaagaacgtgacggaggtcaaaggctacaccaaaggcggaccggggcacgaggagcccatccccatggccacctacggctggaacctggtaaagctgcacagcggcgtggatgtattctacaaacctaccgagcaggtagacaccctcctgtgcgacataggggagtcttccagcaacccgaccatcgaagaaggtcggaccctgcgcgtgctgaagatggtagagccgtggctgtcttcaaagcccgagttttgcatcaaggtgctgaacccctacatgccgacggtaatcgaagaactggagaagctccagcgcaagcatggaggcaacctggtcagatgccccctctcacggaacagcacccacgaaatgtactgggtgtccggcgcctcggggaatatcgtcagcagcgtgaacaccacctccaaaatgctcctgaaccgcttcacgacccggcaccgcaagcccacctacgagaaagatgtggacctaggcgcagggacccggagcgtttcgacggagaccgagaaacccgacatgactatcatcggccgccggctccagagattgcaggaggagcacaaggagacctggcattacgaccaggagaatccgtaccggacgtgggcataccacggttcgtacgaggccccctccaccggaagcgcctcctccatggtgaacggcgtggtcaagctgctcactaagccctgggatgtgatcccgatggtgacccaactggcaatgacggacacgaccccattcgggcagcagcgcgtgttcaaggagaaggtcgacacccggacgcctcagcccaaaccgggcacccgcatggtgatgacaactacggcaaactggttgtgggctctcttggggaagaagaagaacccccggctgtgcacccgcgaagagttcatctcaaaggtccggagcaacgctgcgatcggcgccgtattccaagaggagcaaggatggaccagcgcttccgaggcagtaaacgacagccgcttctgggagctcgttgacaaggagcgggccctgcaccaagaaggcaagtgtgagtcatgcgtgtacaatatgatgggcaaaagggagaagaagttaggggagtttggccgcgccaagggatcacgggccatttggtacatgtggctcggcgcccgcttcctggaatttgaggccctggggttccttaacgaagaccactggttcggtcgggagaactcctggagcggtgttgagggggagggcctacaccgcctgggttacatcctggaggagatcgacaagaaagacggcgacctgatgtacgccgacgacacagcgggctgggacacgagaatcactgaggacgatctccaaaatgaagaactcatcaccgagcaaatggcgccccaccacaaaatccttgccaaagccatattcaagctgacctaccagaacaaagtcgtgaaggtgctccggcccacgcctagaggggccgtcatggacatcatctcccgcaaagaccagcggggaagcggacaggtgggcacgtacgggttaaacaccttcaccaacatggaggtgcagctcatccgccagatggaggcagaaggcgtcatcacacaagacgacatgcagaatcccaagggccttaaggagcgggtggagaagtggctgcgagagtgcggggtggaccggctgaagcgcatggcgatttccggcgatgattgcgtagtgaagccactcgacgagcggttcgggaccagcctactcttcctcaacgacatgggcaaggtgcgcaaggacatcccccagtgggagccttccaaggggtggaaaaactggcaggaggtccccttttgttcgcaccattttcataaaatcttcatgaaggacggccggtccctggtggtgccctgccgcaaccaggacgagctgattggccgggcccgcatcagccagggtgccggctggtcgctgcgcgagaccgcctgcctgggaaaggcctacgcgcagatgtggagcctgatgtacttccatcgccgcgaccttcgattggcctccatggccatctgcagcgccgtcccgaccgaatggttcccgacctccagaacgacctggtctatccacgcccaccaccagtggatgaccacggaggacatgctgaaggtgtggaatcgggtatggatagaagacaaccccaacatgatcgacaagactcccgtccactcatgggaggacattccctacctcggcaagcgcgaggacttatggtgtgggtccctgatcggcctctcatcccgtgcgacatgggcgaagaacatccacacggcgatcacccaggtccgcaaccttatcggcaaggaggagtacgtggactacatgccggtcatgaagcgttacagcgccccctccgagagcgagggggtcctgtaa

SEQ ID NO: 26315 - RNA, 9867 nt, synthetic construct
  misc_feature 1..9867: note = derived and/or modified CDS sequence (opt11) from DENV-4__KJ596661__SS-prME
  source 1..9867: mol_type = other RNA
tctaccatcaccctgctctgccttatccccacggtgatggccttccacttatccaccagggacggtgaacctctcatgatcgttgcgaaacatgaacggggccgcccccttctattcaagaccactgagggcattaacaagtgcacgctcatcgcgatggacctgggggagatgtgtgaagacaccgtgacctacaagtgccctctgctcgttaacaccgagccggaggacattgattgctggtgcaacctgacgagcacatgggtcatgtacggcacctgtacacaatccggggagagacgccgggaaaagcgatcagtagccctgacgccgcactccggcatgggcctcgagacccgggccgagacctggatgtcctccgagggggcatggaagcacgcgcagcgggttgagtcgtggatcctgcggaatcccggcttcgcactgcttgccgggttcatggcctacatgataggccagacaggtatccagcgcacggtcttcttcgtactgatgatgctggtggccccatcctacggcatgcggtgtgttggcgtgggaaaccgagatttcgtcgaaggcgtctccgggggcgcgtgggtggacctagtgctggaacacggcggctgtgtcaccaccatggcccaaggcaagcctaccctggacttcgaactcacgaagaccacagcaaaggaagttgcgctgttacggacctactgcatcgaagcactcatctccaacatcacgaccgcgacccgctgcccgacacagggggagccctacctgaaagaagaacaagatcagcaatacatctgtcgccgcgacgtggtcgacagaggctgggggaacggctgtggactgtttgggaagggcggagtagtgacgtgcgcgaagttcagctgttccgggaagatcaccgggaatcttgtacagatcgagaatctggagtacactgttgtagtcaccgtccacaacggcgacacccatgccgtcggcaacgacactagcaaccatggggtgaccgccaccatcacgccccgctcccccagcgtagaggtcaagctgccggactacggcgagctcaccctagattgcgagccccggtccggcatcgactttaacgagatgattttaatgaagatgaaaaagaagacctggcttgttcacaagcagtggttcctggatctgcccctcccctggaccactggagccgatacttccgaggtgcactggaactacaaggagcgcatggtcaccttcaaggtgccgcacgcgaagcgccaggacgttaccgtcctagggagtcaggaaggcgccatgcatagcgccctggccggagcaaccgaggtagacagcggggacggcaaccacatgtttgcggggcacctcaagtgcaaggtgcgcatggagaagctgcgaatcaagggcatgtcatacacgatgtgcagcggtaagttctccatcgacaaggagatggccgagacccagcacgggaccaccgtcgtaaaggtgaagtacgagggagccggggccccctgtaaggtccccatcgagatccgggacgtgaacaaagagaaggtggtaggcagggtgatcagcgccacccccctggcggagaacacgaactctgtgaccaacatcgagctcgagccgcccttcggggacagctacatcgtcatcggggtcggcaactccgccttaaccctgcactggttccggaaggggagcagcatcggcaagatgttcgagtcaacgtaccgcggtgccaaacggatggcgatcctcggcgagactgcgtgggactttgggagtgtaggcggcctgttcacttcgcttgggaaggccgtacaccaggtgttcggctccgtgtacaccacgatgttcgggggcgtctcatggatgatccgcatacttatcgggttcctggtgctgtggatcggcacgaattcccggaacaccagtatggccatgacatgcatagccgtcggcgggattacgctgttccttgggttcaccgtccaggccgacatggggtgcgttgtatcatggagcggtcgcgaactaaaatgcgggtccggcatcttcgtcgtggataacgtccacacctggaccgagcagtacaaattccagcccgagagccccgcgagactggcctctgccatcctaaatgcgcacaaagatggcgtctgcgggatccgctctacgacccggctggagaacgttatgtggaagcagataaccaacgagctgaactatgtactgtgggagggcgggcatgacttaaccgtcgtcgctggcgacgtcaagggcgttctgacgaagggcaaacgcgcgttgaccccgcccgccagcgacctgaagtacagttggaagacatggggcaaggccaagattttcacccccgaggcccggaacagcacgttcctgatcgacggccccgacacctccgagtgcccgaacgagcgccgggcctggaactcttttgaggtcgaggactatggcttcgggatgttcaccaccaacatatggatgaagttcagagagggctccagcgaggtctgcgaccaccggctaatgtccgcggccatcaaggaccagaaggccgtccacgccgatatgggctactggatcgagtcatccaaaaaccagacgtggcagatcgagcgcgcgagcttaatagaggtgaagacctgcctgtggcccaagacccatactctctggtccaatggggtgctggagtcacagatgctgatccccaagtcctacgctggcccgttctctcagcacaactaccggcaagggtacgccacccaaacagtcggcccctggcacctcgggaagctggagatagacttcggcgagtgccccggcaccaccgtgacaatccaggagaactgcgaccaccgagggccctccctgcgcactaccaccgccagcggcaagctcgtaacccagtggtgctgtcgcagctgcactatgccgcctctgcggttcctgggggaggacggctgctggtacggcatggagatccgccccctctctgagaaggaggagaacatggtcaagagccaagtgaccgcagggcaaggcacttccgaaaccttctctatgggtttgctgtgcctcacgctgttcgtcgaggagtgcttgcgccggcgcgtgacccggaagcatatgatcctcgcggtggtcatcacgctttgcgccatcatcctgggcgggctcacctggatggatctgctgcgcgccctaatcatgctgggcgacacgatgtccggccggatcggaggccaaacccacctggccatcatggctgtgttcaagatgtcaccagggtacgtgctaggcgtcttcctgaggaaactcaccagtcgggaaaccgcactcatggtgatagggatggccatgacgaccaccctgagcatcccacacgacttgatggaacttattgatggtatttccctgggcctgatcctgctgaagatcgtgacccagttcgacaatacgcaggtcggcaccctagccctatcattaactttcatccgctctacgatgagcctggtgatggcctggcggacgatcatggccgtgctctttgtcgttaccctgataccgctgtgccgaacctcctgcctccagaaacagtcgcactgggtggaaataaccgcgctcatcttgggggcacaggccctcccggtatacctgatgacactgatgaagggcgccagtcggcgcagctggcccctgaacgagggaatcatggcggttgggttagttagcctgctcggatccgccctgttaaagaacgacgtcccgctcgctggcccaatggtggccggggggctcctgcttgctgcttacgtgatgtccgggtcgagcgccgacctgtccctggaaaaggccgccaacgtccagtgggatgagatggccgatatcaccggcagctcccccatcatcgaggtgaagcaggacgaggacgggtcattctccatacgggacgtggaggaaaccaacatgatcaccctcttagtgaagctggcactaatcacggtgagcggtctgtaccccctagctatcccaataaccatgaccctctggtacatgtggcaggtgaagacccagcgttccggtgccctgtgggacgtccccagccccgcggcaacacagaaggccgccttatccgagggggtgtaccggatcatgcagcgcggcctattcgggaagactcaggtgggcgtcgggatccatatcgagggcgtgttccataccatgtggcatgtgacccggggtagcgtgatatgccacgagaccgggcgactggagccctcctgggccgacgtgcgcaacgacatgattagctacggcgggggttggcggctaggagacaaatgggacaaagaggaggatgtgcaggtcctcgcaatcgaaccgggcaagaaccccaagcacgtacaaacgaaacccgggttattcaagaccctgaccggggagatcggcgccgtgacccttgactttaaacccggcacctccggcagcccaatcatcaatcgtaaaggcaaggtaatcgggctgtacggcaacggggtggtgaccaagagtggagactacgtcagcgcgatcacacaagctgagcgcatcggggaaccagattacgaggtggatgaggacatctttcgcaaaaagcggcttactatcatggacctacaccccggcgccggcaagacgaagcgcatcctgccttccatcgtgcgggaggccctgaagcgccggctgaggaccctgatcctggctccaacgagagtggtggcagccgaaatggaggaggcccttagagggctgccgataagatatcagaccccagccgtgaaaagcgaacacacgggccgcgaaatcgttgacctgatgtgccacgcgaccttcaccacccggttgctctccagcacgcgcgtaccgaactacaacctgatcgtcatggacgaagcgcacttcaccgacccatcgtccgtcgctgctcgggggtacatcagcacccgcgtggagatgggtgaagccgcggccatcttcatgacagccacgccccccggcgccaccgaccccttcccccagtccaacagccccatcgaggacatcgagcgggagatcccggagcgctcctggaacaccgggtttgattggatcaccgactaccagggcaagaccgtctggttcgtgccgagcataaaggctgggaacgatatcgcgaactgcctccgtaagtcgggcaaaaaggtgatccagctcagccggaagaccttcgacaccgaataccccaagacaaagctgaccgactgggactttgtcgtgacaacggacatctctgagatgggggcgaacttccgcgcaggccgggtgatagacccccgccggtgcttgaagcccgtgatcctaactgacgggcccgagcgcgtcattcttgccgggcccatcccggtgactccagcgtcagccgcccagcggcgcggccgaatagggcgcaacccggcgcaagaggacgaccagtacgtattctctggcgaccccctgaagaacgacgaggaccacgcccactggacagaggcgaaaatgctcttggacaatatctacaccccagagggtatcatccccaccctcttcggcccggagcgggagaagacgcaggccatagacggcgagttccggctccggggtgagcagcgcaaaaccttcgtggaacttatgcggcgcggcgacttgcccgtgtggctctcgtacaaggttgcctccgcagggattagctacaaggaccgggagtggtgcttcaccggcgagaggaataaccagatcttggaggagaatatggaggtagagatctggaccagagagggggagaagaagaagctgcggcccaagtggctcgacgcccgggtctacgcggaccccatggccctcaaggattttaaggagttcgcctccggccgcaagagcatcacccttgacatcctcacggaaatcgcgtccttacccacctacctatcgtcccgcgcaaaactcgcgctggacaacattgtcatgctgcacacaaccgagcggggcgggcgagcctaccaacatgcactgaatgagttgcccgagagcctggagacgctcatgctggtggccctgctcggcgcgatgaccgccgggatcttcctattcttcatgcagggcaagggcatcggcaagctgagcatgggcctcatcaccatagccgtggcctccgggctgctgtgggttgccgaaatccagccccagtggatcgcggctagcatcatcctcgagttcttccttatggtgctcctcataccggagcctgagaagcagcggacccctcaggacaaccagttaatctatgtgatcctgacgatcctcaccatcatcggcctgattgccgccaacgaaatgggcctgatcgagaagaccaagaccgacttcggcttctaccaggtcaagacggagacgaccatcctcgacgtggacctgcgcccagccagcgcgtggaccctgtacgcagtggccacgactatcctcacccccatgctgcggcataccatcgagaacacgtccgccaatctgtccctcgccgcgatagccaaccaggccgcggtgctgatgggacttggcaagggctggcctctccaccgtatggacctgggcgtgcccctcctcgccatgggttgctacagccaagtgaatcccacgaccctgacagcttccctggtaatgctcttggtgcactacgcaatcattgggccgggccttcaagccaaggccacgcgggaagcgcagaagcgcaccgctgccgggataatgaaaaaccccaccgtagatgggatcaccgtcatcgatctcgagcccatcagctatgacccgaagttcgagaagcagctgggccaggtgatgctgttggtgctgtgcgccgggcagctgctccttatgcggacgacatgggccttctgtgaggtcctgactctcgctaccggcccgacccttacactgtgggaggggaaccccggccgcttctggaataccaccatagccgtgtcgacggcaaatatcttccgcggtagctacctagccggggccggcctggcgttctccctcatcaaaaacgcccagaccccccgccgggggaccggcaccgccggggagaccctcggagagaagtggaagcgacagttgaacagcctggaccggaaggaattcgaggagtataagcgcagcggcattctcgaagttgaccggacggaggccaagagcgcccttaaagacgggtccaagatcaagcacgcggtgtcacgcggctcctcaaagattcggtggatcgtggagcgcgggatggtgaagcccaaaggcaaggtcgtcgacctgggctgcggcagaggcgggtggtcctactacatggcaaccctcaaaaatgttaccgaggtgaagggctataccaaagggggcccggggcacgaagagcctatccccatggctacgtacggctggaacctggtgaagctccacagcggcgtggacgtcttctacaagccaaccgaacaggtagacaccctcctgtgcgacatcggggagagctccagcaacccgaccatcgaggaaggccggacgctacgggtgctcaagatggtcgagccttggctctccagcaagccagaattctgcataaaggtgctgaacccctatatgccgacggtgattgaggagttagagaagctccagcggaagcacgggggcaacttggtcagatgccccctgtcccgcaactctacccacgagatgtattgggtgtccggcgcaagcggaaacatcgtgtcgagcgtgaacaccacctccaagatgttgctcaaccgcttcactacccgacaccgcaagcctacctacgagaaagatgtggacctgggcgcgggcacccggtctgtctccaccgagaccgaaaagcccgatatgaccatcatcggccgtcggctccagcgcctgcaggaggagcataaggagacgtggcactacgaccaggagaatccgtaccggacctgggcctaccacgggagctacgaggccccttccaccggcagcgcgtcaagcatggtgaacggggtggtaaagctgctcacaaagccctgggacgtaatcccgatggtgacacagctcgccatgaccgacaccaccccattcggacagcagcgggtcttcaaagaaaaggtggacacgcggaccccccagccaaagccgggcacccgcatggtgatgaccacgacggccaattggctgtgggccctcctggggaagaagaagaaccctcggctgtgcacccgagaggagttcatatccaaggtcagaagcaacgctgccatcggcgccgtgttccaggaggagcaggggtggaccagcgcatcagaggccgtgaatgactcccgcttctgggagctcgtcgacaaggagcgggccttacatcaagagggcaagtgcgagtcttgtgtgtacaacatgatgggcaagagggagaagaaactgggggaattcggccgcgccaaaggctcccgcgccatttggtacatgtggctcggcgcgcgcttcttagagttcgaggcgctggggttccttaacgaggaccactggtttggccgggagaattcctggagcggcgtcgagggggaaggccttcaccgcctgggctacatcttggaggaaatcgacaagaaagacggggacctgatgtatgccgacgacacggccggatgggacacccggatcaccgaggacgacctgcagaacgaggagctgattaccgagcaaatggcaccccaccacaagatcttggccaaggccatattcaagctgacctaccagaacaaagtcgtgaaggtgctccgcccgacaccgcggggggccgtgatggacatcatctcccgcaaagatcagcggggcagcggccaggttggaacatatggactgaacaccttcacaaacatggaagtgcagctgatacgccagatggaggccgagggcgtcatcacgcaagacgacatgcaaaaccccaaggggctcaaagagagggtggagaagtggttacgcgagtgcggagtcgaccggctgaagagaatggcgatctcaggcgacgactgtgtcgtgaagcccctcgacgaacgttttgggaccagcctgctgttcctcaacgacatgggcaaggcccggaaggacatcccccagtgggagccttccaaggggtggaagaactggcaggaggtgcccttctgcagccaccacttccacaagatcttcatgaaggatggcagatcgttagtcgtgccctgccgcaaccaggacgagttgataggccgggcccgcatcagccagggggcagggtggtccctccgcgagaccgcttgtctgggaaaggcgtacgctcagatgtggtcactgatgtactttcaccggcgcgacttgagactggccagcatggcgatctgcagtgccgtccccaccgagtggttcccaacgagccgcactacctggtccattcatgcgcaccaccagtggatgactactgaggatatgttaaaggtctggaaccgggtttggatcgaggacaaccccaatatgatagacaagacgcctgtacatagttgggaggacatcccatatctcggaaagcgagaggacctgtggtgcggatcgctgatcggcctgagctcccgggctacgtgggctaagaatatccacaccgcaatcacgcaggtacgcaacctgatcggcaaagaggagtatgtagattacatgccggttatgaagcggtacagcgccccctctgaaagtgagggagtcctgtga

SEQ ID NO: 26316 - RNA, 9867 nt, synthetic construct
  misc_feature 1..9867: note = derived and/or modified CDS sequence (opt11) from DENV-4__KJ596663__SS-prME
  source 1..9867: mol_type = other RNA
agcaccatcacccttctctgcctgatccccaccgtgatggccttccacctgtccacccgcgatggcgagccgttaatgatcgtcgccaagcatgagcgggggagacccctgttgttcaaaaccactgagggcataaataagtgcacgctcatagcgatggatctgggggagatgtgcgaagacactgtgacttacaagtgccccctgttagtaaataccgagcccgaagacatcgactgttggtgcaacctaacgtcaacctgggtgatgtacggcacctgcacccagtctggggagaggcgccgggagaagcgcagcgtagccctgactccccactccggcatgggcctcgagacccgcgctgagacctggatgtcgtccgagggggcctggaagcacgcccaacgcgtggagtcgtggatcctgcggaatcccggctttgctctcctcgctgggttcatggcgtacatgatcggccagaccgggatccagaggacggtcttcttcgtactaatgatgctggttgccccatcctatggcatgcgttgtgttggcgtggggaatcgcgatttcgtggagggcgtcagcggaggcgcgtgggtggacctggtgcttgagcatgggggctgtgttactaccatggcccagggcaaacccaccctggacttcgagctcacaaagaccaccgccaaggaggttgcgttgctgcggacctactgtatcgaggccctaatcagcaacatcacgaccgcgacccgttgcccaacccagggggagccatacctgaaggaggagcaggaccagcagtacatttgtagacgcgacgtggtcgaccggggttgggggaacggctgcggcctgttcgggaagggaggggtggtgacgtgtgccaagtttagctgctccggaaagatcaccggaaacctcgtgcagatcgagaatctggagtacactgtggtggtcaccgtccacaacggagacacgcacgccgtgggcaacgataccagcaaccacggggtgactgccaccattacgccgcgctcccccagcgtggaggtcaagctgccggactacggggagctgaccctggactgcgagccccggtccggcatcgacttcaatgagatgatactgatgaaaatgaagaagaaaacctggctcgtccacaagcagtggttcctggacttgcccctgccctggaccacaggtgccgacacgtcagaagtgcattggaattataaagaacgcatggtcaccttcaaggtaccacacgcgaagcgtcaggacgtgaccgtcctgggctcccaagagggggcaatgcacagcgccctggccggcgcaactgaggttgactctggggacggcaaccacatgttcgcggggcacctcaagtgcaaggtgcggatggagaagctaaggatcaaggggatgtcctacacgatgtgtagcggcaagttctccatcgacaaggagatggcagagactcagcacgggaccactgtagtgaaggtgaaatacgagggcgccggggccccctgcaaggttcctatcgagatccgggacgtgaacaaggagaaggtggtcgggcgcgtcataagcgccacgcccctggcggagaacaccaatagtgtgaccaacatcgaactcgagccgccctttggggatagctatatcgtcattggcgtgggaaactccgccctaaccctgcattggtttcgcaaggggagctccatcggcaagatgttcgagtcgacgtatcgcggggctaagagaatggccatactcggtgagaccgcgtgggacttcgggtccgtgggcggcctattcacaagcctgggtaaggccgtccaccaagtcttcggctccgtgtataccacgatgttcgggggcgtgtcgtggatgatcaggatactcatcggattcctggtgctgtggatcggcacaaactcccggaatacttcaatggccatgacctgcatcgctgtgggaggcattacgctgttcttgggcttcaccgtccaggccgacatggggtgcgtggtttcgtggagcggtcgcgagctgaaatgcggatccggcatcttcgttgtggacaacgtgcacacctggaccgagcagtacaagtttcagcccgagtctccggcgcgattagcaagcgccatcctcaacgcccacaaggacggcgtctgcggaatccgctccacgacccggctggaaaacgtgatgtggaagcagatcaccaacgagctaaactacgtcttatgggagggcggccacgacctgaccgttgtggccggcgacgtgaagggcgtactgacgaaggggaagcgcgccctcacaccgcctgccagtgacttaaagtacagttggaagacctggggaaaggccaagatcttcaccccagaggctcggaatagcacgttcctcatcgacggccctgacacctccgagtgcccgaacgagcgcagagcctggaatagcttcgaagtggaggactacggcttcgggatgttcaccaccaacatatggatgaagttccgcgagggctcgagcgaggtgtgcgaccatcggttgatgtccgctgcaatcaaggaccaaaaggccgtccacgccgacatgggctactggatagagagctccaagaatcagacgtggcagatcgaacgcgcgtccttgatcgaagtgaagacctgcctgtggcccaagacacacacactctggtccaacggtgtgctcgaaagccaaatgctcattcccaagtcctacgcaggcccgtttagccagcataactaccggcaggggtatgccactcaaactgtcggcccctggcacctcgggaagctcgagatcgatttcggcgagtgccccggcaccaccgtgaccatccaggaaaattgtgaccaccgcgggccctccctgagaacgaccaccgctagcggcaagctcgtcacgcagtggtgctgccggagctgcacgatgccccccctgcgctttctgggagaggatggctgttggtacgggatggagatccggcccctctcggaaaaggaggaaaacatggtgaagagccaggtgacagctggccagggcacctccgagaccttctcaatggggctattgtgcctcacgctgtttgtcgaagagtgcctgcgccggcgcgtgacccggaagcacatgatcctcgcggttgtcatcaccctgtgtgccattatacttggcggcctcacgtggatggacttattacgcgcgctcataattcttggcgacacgatgagtggccggattgggggacagacccacctggcgatcatggccgtgtttaagatgagccccggttacgtgttgggtgtcttcctgcgcaagctgaccagtcgggagaccgcgctcatggtgatagggatggccatgacgactaccctaagcataccccacgacctgatggaactcatcgacggaatctccctgggactaatcttgctgaaaatcgtgacccagttcgataacacgcaagtcggcaccctagccctaagcctcacatttatacgcagtaccatgagcctcgttatggcctggaggacgatcatggcagtgttatttgtcgtgaccctgatcccgctttgccgcacctcctgcctccagaaacagtctcactgggtggagataaccgcactcatcctgggcgcgcaggccctccccgtatacctgatgacgttgatgaagggggcatcccggcgcagctggccactcaacgagggcatcatggcggtggggctggtgtcgctgttgggcagcgccctgctgaagaacgacgtccctctcgccggcccaatggtagccggtgggctgctgttagccgcttatgtgatgtccgggagcagcgctgacctgtccctggaaaaggccgccaacgtccagtgggatgagatggccgacatcaccgggagcagtcccatcatcgaagtgaagcaggacgaggacggaagcttctccatccgggacgtggaagagacgaatatgattaccttactggtcaagctggcgctcatcacggtgagcggcctgtaccccctggccatccccatcaccatgaccctctggtatatgtggcaggttaagacccagcgcagcggcgccttgtgggacgtcccatctcccgccgccacccagaaggcggccctgtcggagggggtgtaccggatcatgcagaggggcctcttcgggaagacgcaggtgggcgtcggaatccatatggagggagttttccacaccatgtggcacgtgacccggggttccgtcatctgtcacgagaccgggcgcctggagccatcctgggccgacgtgagaaatgacatgatctcttacggcgggggctggcggctaggagataagtgggacaaggaggaggacgtgcaagtcctcgcaatcgagccggggaagaaccccaagcacgtgcagacgaagcccggcttattcaagaccctgaccggggagatcggcgcagtgaccctagacttcaagcccgggacatccggcagcccgatcattaaccgaaagggcaaggtgattgggctgtacggcaacggggtggtaaccaagtccggcgactacgtcagcgctatcacccaggccgagcggattggggagcccgactacgaggtagacgaggatattttccggaagaagcggctgaccataatggacttacatcccggtgcgggcaagacgaaaaggatcctgccgtccatagtgcgggaagccctgaagcgccggctaaggaccctcatactcgcgcccacccgggtggtggccgctgagatggaggaggccctgcgtggcctccccatccgctaccagacccccgccgtgaagagcgagcatacgggcagggaaatcgtcgacctgatgtgccacgcgacatttaccacccggttgctttccagcacacgcgtgccgaactacaatctgatagtgatggacgaagcacacttcacagaccccagctccgtcgccgcccgagggtacatcagcacgcgcgtggagatgggcgaagccgcagccatcttcatgaccgcaacaccccccggagccactgacccattcccccagtccaacagccctatagaggatatcgagcgggagatccccgagcgctcctggaacacaggcttcgactggattaccgactatcagggtaagacggtctggttcgtgccgagcattaaggccggcaacgatatcgcgaattgcctacgcaaatccggcaagaaggtgatacaactcagtcggaagaccttcgacacggagtaccccaagacgaagctgacggattgggacttcgtcgtgaccaccgacatctccgagatgggggccaacttccgcgccggccgggtgatcgatccccgccgctgcctgaagcccgtcatcctcactgacgggcccgagcgcgtgatcctggccggcccgattcccgtgacgcccgcgagcgccgctcagcggaggggccggatcggccgcaaccctgcccaagaggacgaccagtacgtgttctccggcgacccactgaagaatgacgaggaccatgcccactggacagaggcgaaaatgctcctggacaacatctacacacccgaggggatcatccccaccctgttcggcccggagcgggagaagacgcaggctatcgatggcgaattccgcctcaggggggagcagcgcaagaccttcgtggagctgatgcgtcgcggtgacctgccggtgtggctcagctacaaggtagcctctgccgggatctcctataaggatcgggagtggtgcttcaccggcgaacgaaacaaccaaatcctagaggagaacatggaagtagagatctggacccgggagggggaaaagaagaaattgcgacccaagtggctcgacgcccgggtgtatgcggaccctatggccctaaaagactttaaagagttcgcgtccggccgtaagagcataacactagacatcctcacggagatcgcctcccttcccacatacctgagcagtcgcgccaagctagcgctggacaacatagtcatgctgcataccaccgagcggggagggcgcgcctaccagcacgccctcaacgagctgcccgagagcctggagacgctcatgttggtggcactgctcggagccatgaccgccggtatcttcctgttcttcatgcagggaaaggggataggtaaactgagcatgggccttataacaatcgcggtggccagcgggctgttatgggtcgcggagatccagccccagtggatcgcagccagcataatcttggaattcttcctcatggtgctgctcatcccggagcccgagaagcagcggaccccccaggacaatcaactgatctacgtgattctgacaatactcaccattatcgggctgattgccgcgaacgaaatgggactgatcgagaagaccaagaccgacttcggtttctaccaggtgaagacggagaccaccatcctagatgtggacttacgcccagcctccgcatggacgctgtacgcggtggccacgaccatcctcacgccgatgctgcgccacaccatagagaacaccagcgccaacttatccctcgccgcgatcgcgaaccaggccgccgtcctcatggggctgggcaagggctggccactccaccggatggacttgggggttcctttgctcgccatgggctgctactcccaggtaaaccccaccaccctgaccgcgtccctggtcatgctgctggtgcattatgccatcatcggtccgggccttcaggccaaagccacgcgggaggcgcagaagcgcactgccgccggcatcatgaagaaccccaccgtggacgggatcacggtcatcgatctcgagcccatcagctacgaccccaaattcgagaagcagctgggtcaagtgatgctgctcgttctgtgcgccgggcaattactcttgatgcgaacaacctgggctttttgcgaggtcctaaccctcgcgaccggccccattctaacgctttgggaagggaaccccggccgattctggaacaccaccatcgcggtgtccaccgccaacatcttccgcggatcctacctagccggcgccggccttgcgttctcgctcattaagaacgcccaaacgccccggcgcgggaccggcaccgccggggagaccttgggcgagaagtggaagcgccagctgaactcactggaccggaaggagttcgaagagtataagcgctccggcatactcgaggtggaccggaccgaagctaagtcggctctgaaggacgggtctaagataaagcacgctgtcagccgcggatccagcaagatccggtggatcgtggagagagggatggtgaagccaaaaggcaaggttgtggacctggggtgtggccgcggggggtggtcatactacatggccactctgaagaatgtgacggaagtcaagggctacaccaaaggtggcccggggcatgaggaacccatccccatggccacctatggctggaatctcgtgaaactgcatagcggtgtggacgtcttctacaaacccaccgagcaagtggatacattactgtgcgacatcggggagagctctagcaacccgaccatcgaagaaggtcggaccttgcgcgtgttgaagatggtagaaccctggctgtcgagcaagcccgagttttgcatcaaggtgctgaatccttacatgccgacggtgatcgaggagctggagaaactccagcgcaaacacgggggcaacctggttcgttgccccctatcccggaacagcacccatgagatgtattgggtttccggcgcgtctgggaacatcgtatcctcagtgaacaccacttccaagatgctcctgaaccgattcacgacccggcaccgcaaacctacctatgagaaggacgtggacttaggcgcggggacccggagtgtctccacagagaccgagaaacctgacatgaccatcatcggacgccggctacagcgcctgcaggaggaacacaaggagacctggcactatgaccaggagaacccataccggacgtgggcctaccacgggagctatgaggccccgtccaccggcagtgcctccagcatggtaaacggggtggtcaaactgctcaccaagccctgggatgtgatcccgatggtgacgcagctggccatgacagacaccacccccttcgggcaacagcgcgtcttcaaggagaaggtggacacgcggaccccccagcccaagccgggcacccgaatggtcatgaccaccacggcaaactggctgtgggccctcctggggaagaagaagaacccgcggctgtgcacaagggaggagtttatctcaaaagtccggagcaacgcggccatcggggcggtgttccaggaggagcagggctggaccagcgcgtccgaggccgtaaacgactcacgcttctgggagcttgtcgacaaagagcgagccctccaccaggaaggcaagtgcgagtcctgcgtgtacaatatgatgggcaagagagagaagaagctgggagagttcggtcgcgccaaggggagccgggcgatctggtacatgtggctcggcgctagattcctagagttcgaggcacttggttttctgaatgaggaccactggttcggccgggagaacagctggagcggcgtggagggggagggcctgcatcgcctggggtacattctcgaggagatcgataagaaggatggagatctcatgtacgccgacgacacagccggctgggatactcggatcaccgaggacgatctgcagaacgaggagttgattaccgaacagatggctcctcaccataaaaccttagccaaggccatcttcaagctgacctaccagaacaaggtcgtgaaagtgctccgccccacgcccagaggggccgtaatggatattatctcccgcaaagaccagcggggcagcggacaggtaggcacctacgggctgaataccttcaccaacatggaggtgcagctaatcaggcagatggaggccgagggcgtaatcacgcaggacgatatgcagaacccgaagggcctcaaagagcgggttgagaagtggctgcgcgagtgcggtgtggacagactgaagcgcatggcgatctccggcgatgactgtgtcgtgaagcctctggacgagcggttcgggaccagcctgttattcttaaatgatatgggcaaggtgcgcaaggacatcccccagtgggagccgtccaaggggtggaaaaactggcaggaggtacccttctgcagccaccacttccataaaattttcatgaaggatggccggtccctggtggttccctgccggaaccaggacgagctgataggtcgggcccgcatttctcagggggcgggctggtcgctccgggagaccgcctgcctggggaaagcctacgcacagatgtggagtctgatgtacttccaccgtcgcgacctcaggttggcctccatggccatctgcagcgccgtccccaccgagtggttcccgacgagcagaaccacctggtccatccacgcccaccaccagtggatgactacggaagacatgctgaaggtttggaaccgggtatggatcgaggacaaccccaacatgatcgacaagacccccgtccacagctgggaggacataccctacctcggcaagagagaggacctgtggtgcgggtccctgatcgggctcagctcccgggcaacctgggctaagaacatccacaccgccataacgcaggtgcggaacctgatcgggaaagaggaatatgtcgactacatgccggtcatgaagagatatagtgctccctccgagagcgaaggggtgctgtag

SEQ ID NO: 26317 - RNA, 9867 nt, synthetic construct
  misc_feature 1..9867: note = derived and/or modified CDS sequence (opt11) from DENV-4__KJ596664__SS-prME
  source 1..9867: mol_type = other RNA
agcaccatcaccctgctctgtctgatccccacggtgatggctttccacctgtccacccgcgacggcgagccgctcatgatcgtcgccaagcacgagcgtgggcgccccctgctgttcaagaccacggaggggatcaataagtgcacgctcatcgcgatggacctgggtgagatgtgcgaggataccgtgacctacaagtgccccttgcttgtgaacaccgagcccgaggacatcgactgctggtgcaatcttacgagcacctgggtcatgtacggaacctgcacccagtccggggagcggcgccgggagaagcgcagcgtggctctgacgccgcactcaggcatggggctcgagacccgggccgaaacctggatgagctcggagggggcgtggaagcacgcccagcgcgtggagagctggatcctgcgtaaccccggcttcgcgctactcgccgggttcatggcctacatgatcggccagaccgggattcagcgcacggtcttctttgtgctgatgatgcttgtggctccctcctacggcatgcggtgtgttggcgtggggaaccgcgactttgtggagggcgtctctggcggcgcatgggtggacctcgttctggagcacggagggtgcgtgaccactatggcccagggcaaacccaccctggacttcgagctcacgaagaccaccgcaaaggaggtggccctgctgaggacgtactgcatcgaggccctcatctccaatatcacgaccgcgacccgctgcccgacccaaggggaaccctacttgaaggaagaacaggatcaacagtacatctgccggcgcgacgtggtcgatcggggatggggaaacggctgcggcctgttcggtaagggaggggtggtcacgtgcgctaagttcagttgctccggcaagatcaccgggaacctcgtgcagatcgaaaacctggagtacaccgtcgtggtcacggtgcataacggcgacacccacgcagtcggcaacgacacctcaaaccacggggtgaccgccaccatcacgccacgctccccgagcgtggaagtcaagctgcctgactacggagagctcaccctggactgtgagccccggtcagggattgatttcaatgagatgatccttatgaagatgaaaaagaaaacctggttagtgcacaagcagtggttcctggacctgccactcccttggaccaccggtgccgacacgagcgaggtgcactggaactacaaagaacgtatggtcacctttaaggttccgcatgcgaagcggcaggatgtgaccgtcctggggtcccaggagggcgccatgcacagcgcactagcaggcgcaaccgaggtggacagcggtgacggcaaccacatgttcgctgggcacttaaagtgcaaggtgcgcatggaaaagctgcgaatcaaaggcatgtcctatacgatgtgtagcgggaaattctccatcgacaaggagatggccgagacccagcacggaaccaccgtcgtgaaggtgaagtacgagggcgccggggccccctgcaaggtgcccatcgagatccgggacgtgaacaaagagaaggttgtcggccgcgtgataagcgcaacgcccctggccgagaacacaaactccgtgaccaacatcgagctcgagccgccttttggggacagctacatcgtcatcggcgtgggaaacagcgccctgaccctgcactggttccggaaggggagctctatcggcaagatgttcgagagcacgtaccgcggggccaagcgcatggccatccttggcgagacagcgtgggactttgggtccgtcggcggcctgtttaccagcctggggaaggccgtccaccaggtgttcggctccgtgtacaccaccatgttcgggggcgtcagctggatgatccgtatcctcatcggattcctggttttatggatcggtaccaacagtcggaacaccagcatggccatgacctgcatagctgtcgggggcatcacgctgttcctcgggttcaccgtccaggccgacatggggtgcgtcgtgtcctggagcggccgcgagctgaagtgcgggtccggcattttcgtcgtggacaacgtgcacacctggaccgagcagtacaagttccagcccgagagccccgcgcggctggccagcgccatactaaatgcacacaaggacggcgtatgcggaatccgcagtactacccggctggagaacgtgatgtggaagcagatcacaaacgagctgaactacgtgctctgggagggcgggcacgatctcaccgtcgtcgccggtgacgtgaagggcgtcctgacaaaggggaagcgcgcgctgaccccgccggccagtgacctgaagtactcctggaagacctggggaaaggccaagatcttcacccccgaggcccggaacagcacgttcctgatcgacgggcccgacacctccgagtgccccaacgaacgacgagcctggaacagcttcgaggtggaggattacggcttcggcatgttcactaccaacatctggatgaagtttagggagggctctagcgaggtgtgtgaccaccggctcatgtcagcggctatcaaagaccagaaagccgtccacgcagacatgggctactggatcgagagctcaaagaaccagacgtggcaaatagagcgcgcgagcctgatagaggtcaagacctgcctgtggcccaagacacacaccctctggagcaacggagtgctggaaagccagatgctgatacccaagtcctacgccggcccgtttagccagcataactatcggcagggatacgcgacccagaccgtcggtccctggcaccttgggaagctggagatcgacttcggcgagtgccccggcaccaccgttaccatccaggagaactgtgaccaccgcggtccctctctgcgcacgaccacagccagtggcaaactcgtgacccagtggtgctgccggagctgcacgatgccgcccctgcgcttcttaggggaggacggctgctggtacgggatggaaatccggccgctctccgagaaggaggagaacatggtaaagagccaggtgacggccggccagggcacctccgaaaccttctccatggggttattatgcctcacgttgttcgtcgaagagtgcctgcgccgacgcgttacacggaagcacatgatcctagcggttgtgatcaccctatgtgccatcattctgggtgggctcacttggatggacctgctacgcgctctcatcatgctgggtgatacgatgtccgggcggatcggcggccagacccacctggccattatcgccgtgtttaagatgagccccggatacgtactcggggtcttcctgcgcaagctgacctcacgggagaccgcgctaatggtgatcgggatggcaatgacgaccaccctgagcatcccgcatgacctgatggagctcatcgatggcatctccctgggcctgatcctcttgaaaatcgtaacccagttcgacaacacgcaggtcggaaccctggccctcagtctgaccttcatccgctccacaatgagtctggtaatggcctggcggacaatcatggccgtactcttcgtcgttaccctgattcccctgtgccgcacctcctgcctccagaagcaatctcactgggtggagatcaccgcgctgatactgggcgcccaggctctccccgtttacctgatgacgctgatgaagggggcctcccggcgcagctggcccctcaacgagggtattatggcggtggggctggtttccctgctcggcagtgccctactgaaaaacgacgtcccgctcgccgggcccatggtggccgggggcctgctgctcgccgcatatgtgatgagtgggagcagcgccgacctgtccctggaaaaggccgccaacgtccagtgggacgagatggccgacataaccggtagctctcccattatcgaggtgaagcaggacgaggacgggtcgttctccatccgggacgtggaggagaccaacatgattaccttgttagtcaagctggcgctcataacagtgagcggcctgtaccccctggctattccaatcaccatgaccctctggtacatgtggcaagtgaagacccagcgctccggcgctctttgggacgtcccatcgcccgccgccacccagaaggcggccctgtccgagggggtgtacaggatcatgcaacggggcctcttcgggaagacacaggtgggcgtcgggatccacatggagggcgtgttccacacaatgtggcacgtgacccggggcagcgtaatctgtcacgagaccgggcgtctggagccatcctgggccgacgtgcgaaacgacatgatcagctacggcggaggctggcggctgggcgacaagtgggataaggaggaggacgtgcaggttttggccatcgagcccgggaagaaccctaagcacgtgcagactaagcccggcttgttcaaaactctgaccggagagatcggggccgtgaccctcgacttcaagcccgggacctcgggcagcccgatcatcaaccgcaagggcaaggtcatcgggctgtacggcaacggggttgtgaccaagtccggagactacgttagcgcgatcacacaagccgagcggataggggagcccgactacgaggtggacgaggacatattccgaaagaagcggctgacgataatggacctccaccccggcgccgggaagacgaagcgcatactaccgtccatcgtgcgggaggcactgaagcgccggctacgcacgttgatcctggctcctacacgggtcgttgcagccgagatggaagaggccctccgcgggctccccatccggtaccagacgcccgccgtgaagtcagagcacacgggccgcgagatcgtggacctgatgtgtcacgcgacctttaccacccggttattatccagcacacgcgtaccgaactacaacctgatcgttatggacgaggctcactttaccgatcccagcagtgtcgcagcccgggggtacatcagcacccgtgtggagatgggcgaggcggcggccatcttcatgaccgcgacgcccccaggggcaacagacccgttcccacagtccaacagcccaatcgaagacattgagcgcgaaatccccgagcgatcctggaacaccggcttcgattggataacagattaccagggcaagacggtgtggttcgtgccgagcatcaaggccgggaacgacatcgcgaactgtctgaggaagtccggcaagaaggtgatccagctcagccggaagaccttcgacaccgagtatcccaagaccaagctgactgactgggacttcgtcgtaacaaccgacatctccgagatgggggccaactttcgcgccggacgtgtcatcgacccacgccggtgtctgaagccggtcattctgaccgacgggccggagcgcgtgatcctggccggcccgatccccgtcacacccgcaagcgctgcccagcggcgcggccggatagggcgcaatccggcccaggaggacgaccagtatgtcttctccggcgaccccctgaaaaacgacgaggaccatgctcactggaccgaggcaaagatgcttctggacaacatttacaccccggaggggatcatccccaccctattcggcccggaacgtgaaaagactcaggccatcgacggcgagttccgcctcagaggggaacaacgcaagacattcgtggaactgatgaggcgaggcgacttaccagtttggctctcatacaaggtcgcctccgccgggataagctataaggaccgggagtggtgcttcaccggcgagcgaaataaccagatcttagaagagaacatggaggtggagatatggacccgggagggcgagaaaaagaagctgcgccccaagtggctcgacgcccgggtgtacgctgaccccatggccctaaaggacttcaaggagtttgcctccggccgcaagagcatcacactggacatcctcacggaaatcgccagtctaccgacctacctgagttcccgcgcaaagctcgcgctggacaacatcgttatgctgcacaccaccgagcggggcgggcgtgcataccagcacgccctcaacgagctccccgagagcctggagacgctcatgctggtggccctgctcggcgctatgaccgccggtatcttcctgttcttcatgcagggaaaggggatcggtaagctcagcatgggcctcataaccattgccgtggcctccggacttttgtgggtcgccgagatccagccccagtggatcgcggccagcatcatcttggagttcttcctgatggtgctgctcatccctgagcccgagaagcagcggacaccccaggacaaccaactgatctatgtgatcctgacgatcctcaccatcatcggcctgatcgccgccaacgagatggggctgatcgagaagaccaaaactgattttggcttctaccaggttaagacggagaccaccatcctcgatgtggacctacgccccgcctctgcttggacgctgtacgcggtggccaccaccatcctcaccccgatgctgcggcacaccatcgagaacacgagtgccaacctgtccctcgccgcgatcgccaaccaagccgccgtcctaatggggctgggcaagggctggcccctccaccgcatggacctgggggtgcccctcctcgccatgggatgttacagccaggtgaaccccactaccctgaccgcgtccctggtgatgctcctggtgcactacgctattatcggaccgggcttacaagccaaggctacgcgggaggcgcagaagcgcaccgccgccggcatcatgaagaaccccaccgtggatggaatcaccgtcattgacctcgaacccatcagctacgatcctaagttcgaaaagcagttaggacaggtgatgctgttagtgctgtgcgcggggcagctgctcctgatgcgaacgacctgggcattctgtgaagtactgaccctggcgacaggccctatcctgaccttatgggaggggaaccccggcagattctggaataccaccatagcagtgtccaccgccaacatcttccggggcagctacttggctggtgccggcctggcgttctccctgatcaagaacgcccagactccgcgccgaggcaccggtaccgcgggggagaccctcggagaaaagtggaagcgccagctcaacagcctggaccggaaggagttcgaggagtataagcgatccggcatcctcgaagtggaccggaccgaggcaaagagcgccttgaaggacgggtccaagatcaagcacgcggtcagcagaggctcgagcaagatacggtggatagtggagcgcgggatggtgaagcctaagggcaaggtagtggatctggggtgcggccgcggcgggtggtcctactacatggccacgctcaagaatgtgaccgaggtcaagggctacaccaaagggggtccgggtcacgaggaaccgatccccatggccacctacggctggaacttagtgaagctgcacagcggcgtggatgtgttctacaagcccacggaacaggtggacaccctcctctgcgacatcggggagagctctagtaacccgacaatcgaggagggtagaactctacgcgtgctcaagatggtcgagccctggctgtcaagcaagcccgagttctgcataaaggtgctgaacccgtacatgccgacggtgatcgaggagctggagaaactccagcggaaacacggagggaacctggtccgctgccccctgtcgcgaaacagtacacacgagatgtactgggtctccggcgccagcggtaacatcgtctccagtgtgaacaccacctccaagatgctcctgaaccgcttcacgacccggcaccgaaaaccgacatacgaaaaggacgtggacttgggggcggggacccggagcgtctccacggagatcgagaagcccgacatgacgatcatcggccgccggcttcagcggctgcaggaggagcacaaggagacctggcactatgaccaagaaaacccgtatcgtacctgggcctatcatgggagctacgaggccccctccacgggcagcgcctccagcatggtgaacggggtggtcaagttactcaccaagccctgggacgtgatacccatggtgacacagctggccatgaccgacacgaccccgttcggtcagcagcgcgtcttcaaggagaaggtagacacgcggaccccgcagccaaagccgggcacgcgcatggtgatgactaccaccgccaattggctgtgggccttactgggaaagaagaagaacccccggctgtgcacgcgggaggagtttatctccaaggtccgtagcaacgccgcgatcggcgccgttttccaagaggaacagggatggaccagcgcgtccgaggccgtgaacgacagccgcttctgggagctcgtagacaaggagcgggccctgcaccaagagggcaagtgcgagtcttgcgtttacaacatgatgggcaaacgtgagaagaagctgggtgagttcggccgcgcaaagggtagcagagccatctggtatatgtggttgggcgcgcgcttcctggagttcgaagccttagggttcctgaacgaggaccactggttcggccgtgagaactcctggtcgggagtggaaggtgagggcctgcatcggctggggtacattctagaggagatcgataaaaaggatggggaccttatgtacgccgacgacacagcaggctgggacacccggatcacggaggacgatctgcagaatgaggagttaatcaccgaacagatggcgccacaccacaaaattctggcaaaggccatcttcaagctgacctaccagaacaaggtcgtgaaggtgctccgccccaccccgagaggggccgtcatggacattatctcccgcaaggaccagcgtggctcagggcaagtgggcacatacgggctgaacacgttcaccaacatggaggtgcagctgatccgccagatggaggcggagggcgtcatcacccaggacgacatgcagaaccccaagggcctcaaggagcgggtcgagaagtggttacgggaatgcggcgtggaccggctgaagcgcatggcaatctccggtgacgactgcgtcgtgaagcccctcgacgagcggttcgggaccagcctcctgttcctcaacgacatgggcaaggtgcgcaaggacatcccgcagtgggagccgtccaaggggtggaagaactggcaggaggtaccgttctgtagccaccacttccataagatcttcatgaaagacggtcgttctctggtggttccctgccgcaaccaggacgagctgatcggccgggccaggatcagccagggcgccggctggaacctccgcgagacggcatgtcttgggaaggcctacgcacagatgtggtcgctgatgtacttccatcggcgcgatctccggctggccagcatggccatttgctcggctgtccccaccgagtggttcccaaccagccgcaccacgtggtctatccacgcccaccaccagtggatgaccaccgaggacatgctgaaggtgtggaaccgggtgtggatcgaggacaacccgaacatgatagacaagacccccgtccactcctgggaggacatcccctatttaggcaagcgcgaggacctgtggtgcggtagcctgattggactctctagccgggcaacgtgggctaagaacatacacaccgcgatcacacaggtccgcaacctgatcggcaaggaggagtacgtggactacatgagtgtgatgaagcggtacagcgccccgtccgagagcgagggtgtcctgtga

SEQ ID NO: 26318 - RNA, 9867 nt, synthetic construct
  misc_feature 1..9867: note = derived and/or modified CDS sequence (opt11) from DENV-4__KJ596665__SS-prME
  source 1..9867: mol_type = other RNA
tcaaccataacgctcctttgcctcatccccacggtcatggctttccatttatcaacgcgtgatggggaacccctaatgatagtggctaaacacgaacggggccgacccctcttattcaaaacgacagaaggcataaataaatgcactctaattgcgatggacttaggagaaatgtgtgaagatacggtaacatacaagtgtccgctgttggtaaatactgaacccgaagatattgattgctggtgtaatttaacctcaacatgggtcatgtacggaacctgtacgcagagcggcgaaagaagaagagaaaaacgatctgtagcattaacgccccactctggtatgggattagaaacgagggcggaaacgtggatgtcgagtgagggcgcatggaagcatgcacaaagggttgaatcctggattctccgaaacccggggtttgcattactagcgggattcatggcgtacatgataggacagacaggcatccaacgaaccgtattcttcgtactgatgatgctcgtagcgcctagctacgggatgcgctgcgtaggggtaggaaatagggattttgtcgaaggagtcagcgggggagcctgggtggatctagtgcttgaacacggtggctgtgtaacaacaatggcgcaaggcaaacccaccctcgacttcgagcttacaaagacaacagccaaggaagtagccctgctccgaacctactgcatagaagccctcataagtaacatcacaaccgcgacccgatgccccacccagggagaaccatatttgaaagaagaacaggaccaacagtacatctgccgccgagatgtcgtggacagaggatggggcaacggctgcggcttattcggaaaaggtggagttgtcacatgcgcgaaattctcatgctcaggaaagatcactggaaacctcgtacaaatagagaacctcgaatacacagtagtggtaacggtgcacaatggcgacacgcacgcagtggggaacgacacatctaaccacggggtgaccgcaaccataacaccccggagcccctcggtcgaagttaaattaccagactacggtgaactcacgctagattgcgaaccccggtcaggtattgactttaatgagatgatcctgatgaagatgaaaaagaaaacctggctcgttcacaaacagtggttcttagacttaccactaccctggacaacaggagccgacacctccgaggtacactggaactacaaagagcgcatggtcacgtttaaagttccgcatgcaaagagacaggacgtgacagtgctcggaagccaagaaggcgcaatgcacagcgcactagccggtgcaacggaagtggactcgggcgacggaaaccatatgttcgcagggcacctcaaatgtaaagtacggatggagaaactaagaataaaagggatgtcctacacaatgtgttcgggaaaattctcaattgacaaggaaatggcggaaacccaacacggaaccaccgtagtcaaggtaaaatatgaaggagcaggagccccctgcaaggttcccatagagataagagacgtgaataaggaaaaggtcgttggtcgcgtaatatccgcgacacctttagcggaaaacacaaatagcgtcaccaacatcgagttagagcccccgttcggggatagctacattgtaataggcgtggggaactcagcgttaaccctacactggtttcgcaaaggatcttctatcgggaaaatgttcgagtcgacttaccgcggcgcgaagagaatggctatcctgggagaaactgcatgggacttcggaagcgtcggaggcttgttcacctcactagggaaggcagttcaccaagtgttcggaagcgtttacacgacaatgttcggcggcgtttcctggatgatcaggattctgattggctttctcgtcctgtggatcggcacaaacagtaggaatacaagcatggcgatgacgtgcatcgcggtaggaggcatcaccctattcttggggttcaccgtacaagccgacatgggatgcgtagtaagctggagcggaagggaactcaaatgcgggagtggtatattcgtagtagataacgtacatacgtggaccgagcaatacaaatttcagccagagtccccagccaggctcgctagcgccatcttgaatgcccacaaagacggagtgtgcggaatcagatcgacgacccgactcgaaaacgtcatgtggaaacagataacgaacgaacttaactacgtgctgtgggaaggaggacacgatcttacagtggtcgcgggagatgtgaaaggagtgctcaccaaggggaagcgagccttaacgccgccggcatccggattgaagtacagttggaagacttggggcaaggcaaagatattcacacccgaagcgcgaaactccaccttcctgatcgacgggcccgatacaagtgaatgcccaaacgagcgtcgagcctggaactcgttcgaggtcgaggactacggattcggaatgttcacaaccaacatttggatgaagttccgagaaggatcttccgaagtctgcgaccatcggctaatgtccgccgctatcaaggaccagaaggccgtacacgcggatatgggctactggatcgaaagcagcaaaaatcagacgtggcaaatcgagcgagccagcttaatagaagtaaaaacatgcctttggccaaagacacacacgctatggagcaacggggtccttgagagccaaatgctaatcccgaaaagctacgcggggccattcagtcaacacaattatagacaaggctacgctacgcagactgttggcccgtggcacttgggtaagctcgaaattgactttggcgagtgcccgggaactaccgtgacaatccaagagaactgcgatcacagaggcccatcgctccgcacgactacggcatctgggaagctagtaacgcaatggtgctgcaggtcatgcacgatgccacccctaagattcttgggcgaggacgggtgctggtatggaatggagatccgtccattaagcgaaaaagaggaaaacatggttaagtcacaagtgaccgcaggacaaggcacctccgagacattcagtatgggcctactctgcttgactttattcgtcgaggagtgcttgcgacgtagagtaacccgcaagcatatgatcttagcagtagtgataaccctatgcgccatcatactaggagggctgacctggatggacctcctgagggcgctaatcatcctgggggacacgatgagcgggcgtattggcggccaaacccacctagcaatcatggcagtatttaaaatgtcccctggctatgtactaggcgtattccttaggaaactgacgagcagggaaacagctttaatggtcattgggatggcgatgactacaacgctaagcataccgcacgacctcatggaactgattgacggcataagtctcggtctgattctactgaaaatcgtaacccaatttgacaatacacaagtaggcaccctcgcgctatctctcacgttcatccgatcgacgatgtcgctagttatggcatggcgcaccataatggcagtacttttcgtggtcactctcatccctctatgccgcacatcgtgcttgcaaaaacaatcacattgggtagagataaccgccctaatactgggagcccaagccctaccggtgtaccttatgactctgatgaaaggcgccagtcgcaggagctggcccctaaatgaggggatcatggcggtaggcctggtgtcactactaggcagcgcgctgctgaaaaacgacgtcccgctggcaggtccgatggtcgcagggggccttctgctagcagcatatgtaatgtcaggctcatctgccgacctctcattagaaaaagccgccaatgttcagtgggacgaaatggcagacataaccgggtccagtccgataatagaagtaaagcaagacgaagatggatcattctcaattcgagacgtagaggaaacaaacatgatcactctgctggtaaaactcgcgttgatcacagtcagtggcctgtaccccctcgcaatacccataaccatgacactctggtacatgtggcaagtcaaaacacagcgaagtggggcactatgggacgtgccaagtccagccgcaacccagaaggcggccttgtccgagggcgtgtatagaatcatgcagaggggtctattcggtaagactcaagtcggcgtaggaatacacatggagggcgtatttcacacgatgtggcatgtcactcgagggtctgtcatatgccacgaaacaggccgattagaaccatcatgggcagatgtacgcaacgacatgataagctacggcggagggtggcgtttgggtgacaaatgggacaaggaagaagatgtacaggtcctcgcaatcgagccaggcaaaaacccaaaacacgtccaaacaaaacccggtctcttcaagacgctgacgggagagatcggagccgtcaccttagactttaaaccagggacgtccggatcacccatcatcaaccgaaagggcaaggtcatagggctgtacgggaacggagtcgtaacaaaaagtggggattacgtcagcgccatcactcaagccgaaagaattggggaacctgactatgaagtggacgaggacatattcaggaagaaaagactcacgataatggacctacatccgggggcaggcaaaaccaaacggatcctaccaagtatcgttagagaggccctaaaacggcgcctacggacactcatactcgcaccaacccgtgtcgtagccgcagagatggaagaagcactaagggggctacctatacggtaccagaccccggcagtgaaaagcgagcacaccgggagagaaatagttgacttgatgtgccacgctaccttcacaaccagacttctgagtagcacacgagtacctaactataacctaatcgtaatggacgaggcgcactttactgaccccagctcagtggcggcaagaggatacataagcacacgggttgaaatgggggaggcggcggcaatatttatgacggcgacgccacccggtgccactgacccattcccacaaagcaacagtcctatcgaagacatagaacgcgagatccccgagcgatcttggaacacagggttcgattggataacagactaccaaggcaaaaccgtctggttcgtcccctcgataaaagccgggaacgatatcgccaactgcctacgcaaaagcgggaagaaagtgatccaactatctcgcaagacatttgacacagagtacccaaaaacaaagttaaccgactgggactttgtagtaaccaccgatatcagtgaaatgggtgcaaacttccgcgccggccgggtgatagaccctagaagatgcctcaaaccagtcatcttaaccgacgggccagagagagtgatcctagcagggcccatcccggtcaccccagcgagtgccgcgcaacggagggggcggatcggtcgcaatccagcccaggaagacgatcaatacgttttcagtggggaccccctcaaaaacgacgaggaccacgcacattggaccgaagcgaaaatgctactggataacatatacacaccggaaggcatcattccgacactattcggccccgagcgcgagaaaacacaggccatagatggcgaatttagactaagaggcgagcagcgaaaaacattcgttgagctcatgcgacgcggggacctaccggtatggctgtcttacaaagtcgcgagcgccggcatctcctacaaggacagggaatggtgctttaccggagaacgaaacaaccagatactggaggaaaatatggaagtagagatttggacacgcgagggcgagaaaaagaagctacgtcccaagtggctagacgcaagggtttacgccgaccccatggcactgaaggactttaaagagtttgcctcgggaagaaaatcgataacactcgatatcttaacagaaattgcgagcctcccgacatatttgagtagcagagcaaagctagcactcgacaatatcgtaatgctacataccacggagcgcgggggacgagcttaccaacacgccctcaatgaactgccggaatcgctagagacattgatgctggtcgccctattaggcgccatgactgctggcatctttctattcttcatgcaggggaaaggcattggaaaactgagtatgggcctcataacaatagcggtagcgtcgggactattgtgggtagcggaaatacaaccccagtggatagccgcttcgatcatcctggagttcttcctaatggtattactaatacccgagcctgaaaaacagcgcacaccccaggataatcaactaatctacgtcatcctcaccatattgaccatcatcgggctaatagccgcgaacgagatgggactaattgagaaaaccaagacggacttcggcttctaccaggtaaaaactgaaaccaccatcctagacgtcgacctacgcccagcgtcagcgtggacgttgtacgccgtagcaacaactatactaacgcctatgcttagacatacaatcgaaaatacgagcgcaaacttgtccctggcagccatcgccaaccaggcagcggtccttatgggtttaggcaagggatggccactacacagaatggacctaggagtaccactactagccatggggtgctattcgcaagtgaacccgacaacattaacagcatccctggttatgctccttgttcattatgccataatcggaccaggacttcaagccaaagcaacacgagaagcccagaaacgaacagcagccggtataatgaaaaacccgaccgtggatggaattaccgtaatagacctagaaccgatatcatacgatccaaagtttgagaagcaactcggacaagtgatgctactcgtactctgcgcagggcaactcctgctgatgaggacaacgtgggcattctgcgaagtactaacgctggccaccggccccatcctaacactatgggaggggaacccgggacgcttttggaacaccaccatcgcggttagcaccgcgaacatattccgagggtcgtacctcgctggtgcagggctcgcattcagccttataaagaacgcccaaacaccccgccgagggacagggaccgctggagagacattaggagaaaagtggaaaagacaacttaactctctcgacagaaaggagttcgaagaatacaagaggagcggaattttagaggtcgaccgaacagaagcaaaatccgcacttaaggacggatcgaaaattaaacatgccgtttcgcgaggcagctcaaagataaggtggatagtggaacgagggatggtaaaacctaagggcaaggtcgtagatcttggatgtgggagagggggctggtcgtactacatggcgacactcaaaaacgtcacggaagttaaaggatacaccaagggagggcccggccatgaggagcccattccgatggccacatacgggtggaatctagtaaagctccactcaggcgtggacgtgttctataagccaaccgagcaagttgacaccctgctatgtgacataggagagagcagttcaaatccgacaatcgaggagggacgtacactacgagtacttaaaatggtggaaccatggctcagcagtaaacctgagttctgtatcaaagtccttaacccgtacatgcccacagtcatcgaagaactggagaagctccagcgcaagcacggcggtaacctggtacgatgccctctaagccgaaacagtacgcacgaaatgtactgggtatccggggcgtcgggaaacatcgtcagcagtgtgaacacaaccagcaagatgctattaaacaggttcaccacccgccaccgaaaacccacatatgagaaagatgtcgacctaggggcaggcacgcgaagcgtctccacagaaacggagaaacctgacatgacgataatcggtcgaagactacagaggctacaagaagaacacaaagagacgtggcactacgaccaggaaaacccttaccggacctgggcctaccatggctcgtacgaggcgccatcaacgggaagcgcatcaagcatggtcaacggcgtagtcaagttactaactaaaccgtgggacgtgatacctatggttacccagctagcgatgaccgacacaacccccttcgggcagcaacgtgtcttcaaagagaaagtagacacacggacaccacagccaaaacctgggacccggatggtcatgacaactaccgctaattggctctgggcgctgcttggcaaaaagaaaaacccacgcttgtgcactcgagaggagttcataagcaaagtcagatccaacgccgccatcggagcagtcttccaagaagaacagggatggacgagcgcctcagaggctgtaaacgattcacgcttctgggaactcgtcgacaaagagcgagcactccaccaggaggggaaatgcgagtcctgcgtatacaacatgatgggaaaacgcgagaagaaactaggcgaatttggtagagcaaaaggatcaagagcaatatggtacatgtggctcggcgccagattcctcgagtttgaggccttagggttcttgaacgaagaccactggttcggccgtgagaacagctggagtggagtggaaggtgaaggcttacacaggctaggatacatcttggaggagatcgacaagaaagacggggatctgatgtacgcagacgacacagcgggctgggatacacgaatcaccgaagatgacctccagaacgaagaactgattacagagcagatggcccctcaccacaaaatcttagcaaaggcgatcttcaaactgacatatcagaataaagttgttaaggtactccgccccacgccccgcggggccgtaatggacataatctcacgtaaggatcagcggggaagtggccaagtggggacctacggccttaacactttcaccaacatggaggtgcaactaattcgccaaatggaagcagagggggttattacccaagacgacatgcaaaatcccaaggggctcaaggaacgcgtggaaaaatggcttcgcgaatgtggagtggaccggctcaaacgtatggccatcagtggcgacgactgcgtggtaaaaccacttgatgaaagattcggaacatcactcctgttcctcaacgatatgggaaaggtgcgcaaagacatcccgcaatgggagcctagtaaaggctggaaaaactggcaggaagtaccgttctgcagccaccactttcacaagatattcatgaaggacggcaggagcctagtcgttccctgccggaaccaagacgaactgattggaagggctcgcatcagtcagggggcgggatggtctctcagagaaacggcatgcctcggcaaggcgtatgcgcagatgtggtccctgatgtacttccatcgaagagacctccggttagccagcatggcaatctgcagtgcagtgccaaccgagtggttccccacatcgaggacaacatggagcatccacgcgcatcatcaatggatgaccacggaaaacatgttaaaagtgtggaaccgggtctggatcgaagataaccccaatatgatcgacaagacgcccgttcacagctgggaagatataccatacctgggaaaaagggaggatctctggtgcggatcactcatcggcctaagctcacgagcaacctgggctaagaatatccacaccgccattacccaggtgcgcaacctcatcggcaaagaggaatacgtagactatatgcccgttatgaagcgatatagcgcgcccagtgagagcgaaggagtactttga

SEQ ID NO: 26319 - RNA, 9867 nt, synthetic construct
  misc_feature 1..9867: note = derived and/or modified CDS sequence (opt11) from DENV-4__KJ596668__SS-prME
  source 1..9867: mol_type = other RNA
tccaccattacgctcctctgcctcatcccaactgtaatggcattccacctctcaactagagacggtgaaccgctgatgatagttgccaagcatgaacgaggacggccgttacttttcaagacgaccgaaggaattaacaagtgcacgttgatagccatggacctcggtgaaatgtgcgaagacaccgtgacctacaaatgcccacttctggttaacaccgaaccagaagacatcgactgttggtgcaatcttacctcaacctgggtgatgtacggaacgtgtacgcaaagcggcgaaagacgccgggagaagagaagcgtcgcactgaccccacactcaggcatgggcctggaaactcgggcagaaacatggatgagcagcgaaggtgcctggaagcacgctcaaagagtagagagctggattttgcgaaatccggggttcgcgctcctagccggattcatggcatacatgatagggcaaaccggcatacaaagaacagtgttcttcgtgctcatgatgctagtagccccatcatacggaatgagatgcgtaggggttggaaaccgcgatttcgtggaaggggttagcggcggcgcgtgggtagacctagtactggaacacgggggctgcgtcactacgatggcgcagggcaaaccgaccttagacttcgaactcaccaagaccacagcgaaagaagtcgccctgctacggacctactgcatagaagcgctcatctcaaacataacaacagcgacccgttgtcctacccagggcgagccgtatctaaaagaagaacaagaccagcaatacatatgccgacgtgacgtagtggaccgcggctggggtaacggatgtggcctcttcggaaaaggtggcgtggtcacatgcgccaaattttcctgcagcggaaaaataaccggtaacctagtgcaaatcgagaacctagagtacactgttgtagtcaccgtgcacaacggcgatacacatgcggtagggaacgatacatctaaccatggcgtaacagcaaccatcacaccccgctccccctccgttgaggtgaaactgcctgactacggcgagctaaccctagactgcgagccgcgcagcggtatagacttcaatgagatgatactaatgaaaatgaagaaaaagacatggctcgttcacaaacaatggtttctagatctcccactaccctggacaacgggagccgacacgtctgaagtgcactggaactacaaagaaagaatggtcacattcaaagtcccccatgcaaagcgccaagacgtcaccgtccttggaagtcaagagggcgcaatgcactcggccctagcgggcgccactgaagtcgacagcggcgacggcaaccatatgttcgcgggacacttaaaatgtaaagtccgaatggaaaaacttagaataaagggaatgtcctacacgatgtgctcagggaaatttagcatcgataaagaaatggcggaaacacagcacgggacaactgtggtaaaagtcaaatacgaaggcgcaggcgcaccgtgcaaagtcccgatcgaaatacgagacgtaaacaaagaaaaagtcgtgggccgtgtcatctccgcgacacccctagcggaaaacacaaacagtgtcaccaacatagaactcgagccgccgtttggcgatagctacatcgtaatcggagtaggcaacagcgcactgacactacattggtttagaaagggaagttcaatagggaagatgtttgagtccacttacagaggagcaaagcgcatggcaatactcggcgagaccgcgtgggattttggaagtgtgggcggactatttacatccctagggaaggccgtacatcaagtattcgggtctgtatatacgacgatgttcggaggggtctcatggatgatacgcatcctaataggcttcttggtattatggatcggcaccaactcccgaaatacaagcatggccatgacctgtatcgccgtaggcggcattacactattcttaggcttcacggtccaagcagatatgggctgtgtcgtatcctggagtggaagggagctgaagtgtgggagcggaatcttcgtagttgataacgtacacacatggactgaacaatacaagtttcaaccagagagccccgccagactcgcgtccgccatcctgaatgcccacaaggatggagtctgcggaatcaggtcgacaacacggttagaaaatgtaatgtggaaacaaatcacaaatgaactcaattacgtactgtgggagggagggcacgacctcacagtggtcgcgggagacgtgaaaggcgtactaacaaaagggaaacgcgcgctaacgccaccggcatccgacctaaaatactcatggaagacttggggaaaagcgaaaatattcaccccggaagcccgaaattccaccttcttaatcgacggacctgacaccagcgagtgcccgaatgaaaggagagcatggaacagctttgaggtggaggactacggcttcggaatgtttacaaccaacatttggatgaagttccgagaaggatcgagcgaggtatgcgaccaccgcctgatgagtgccgcaatcaaggaccaaaaagctgtacacgcagacatgggctactggattgaatcgtccaaaaaccaaacctggcaaatcgagcgggcatcactcattgaggtgaagacgtgtctgtggcctaagacccacaccctctggagcaatggggttctagaaagccaaatgcttattcccaagagttatgccggaccgttctcgcagcacaactatcgacaggggtatgccacgcagacagtcggaccatggcaccttggaaaactcgaaatagactttggagaatgccccgggacgacagtaaccatccaagaaaattgcgaccacagagggccctccctacgaacaacgaccgcgagtgggaaactcgtcacgcagtggtgttgccggagctgtacgatgccacccctacgcttcttgggcgaagatggttgctggtatggaatggaaataagacccctctccgagaaagaagaaaatatggtgaagtcccaggtaaccgcaggccagggaaccagcgagacattcagcatgggattgctatgccttaccctcttcgtggaggagtgcctacgccgaagggtcacacgtaaacatatgatcttggcagttgtcataactctgtgcgcaatcatcctcggcggacttacctggatggacctcctgcgagcactaataatactgggcgacacaatgtcaggccggataggaggacaaacacaccttgctataatggcggtatttaagatgtctcctgggtacgtactaggagtcttccttcggaagctgacgagccgggagacggccctgatggtcatcggaatggctatgacgaccacactaagcatcccacacgacctaatggaattaatagacggcattagtctaggcctaatcctgttaaaaatcgttacccaattcgacaacacgcaagtcggtactcttgctttgagtttaacctttatacgctcgaccatgagcctcgttatggcttggaggacaatcatggcggttctcttcgtagtgaccctgatcccgttatgtcgaacatcatgcttacaaaaacagagtcactgggtcgagattactgcactgatcctcggggcccaagcactaccagtgtacctaatgacactaatgaaaggcgcgtcgcgacgctcctggccgctaaatgaaggaataatggctgtcggactggtatccctcctgggttccgcactcttgaagaacgatgtgcccctcgcgggccccatggtggcaggcgggctactcctcgcagcatacgtcatgagcggaagcagtgctgacctgtccctagaaaaggccgcgaatgtgcaatgggatgaaatggctgacatcacaggttcctcaccgataatcgaggtgaaacaggatgaggacggtagtttcagtataagggacgtggaagaaaccaacatgataaccttactcgtaaaacttgctctcatcaccgtcagcggcctgtatcccttggcgataccggtgaccatgacactctggtacatgtggcaagtaaagacgcaaagaagcggcgccttatgggatgtcccttccccagccgctacccagaaagcggccctctctgagggtgtctatcgcatcatgcaaagaggactatttggaaagacacaggtcggggtcggcattcacatggagggagtgtttcacacaatgtggcacgtgacccgcggtagcgtcatatgccatgaaaccggccgcctagagccctcgtgggcggacgtacgtaacgacatgatctcgtatgggggtggatggagattaggcgacaagtgggacaaggaagaagacgtgcaagtgctggcaatagagcccggaaagaacccaaaacacgtgcaaactaaaccaggactctttaaaacgctgaccggcgagatcggcgctgtaacactagactttaaaccaggaacttcaggaagcccaatcataaaccgcaagggtaaggtaatcggactgtacggtaatggggtcgtcacgaagtccggagactacgtgagcgccataacccaggccgaaaggataggcgaacctgactacgaagtcgacgaagacatattccggaagaaacgattaacgattatggacctccacccgggcgcggggaaaacaaagcgaatcctcccgtcaatagttcgagaagcactgaagagacgccttcgcacgttaatattagcacccaccagagtagtagcagctgagatggaagaagcactgcgcggcctcccgattaggtaccaaaccccggcggtcaagtctgagcatacggggagagaaatagtcgatctaatgtgtcacgccacattcacgacccggctactgagcagcacgcgggtccccaactataacctaattgtcatggatgaggcccacttcacggacccgtccagtgtcgcagctagaggctacataagcacaagagtcgaaatgggcgaggctgcagccatcttcatgaccgcgaccccaccaggggcaacagacccctttccccaatcgaacagtccgatcgaagacatagagagagaaattccagagcgatcatggaacacgggatttgactggattactgactaccaaggaaagaccgtctggtttgtcccatctattaaagccggcaacgacatcgcaaactgcctacgaaagtccgggaagaaggtgatccaacttagcagaaaaacgttcgacaccgagtatccaaagaccaaacttacggactgggacttcgtagttacaacagatatatctgaaatgggcgcaaacttcagagcgggcagagtcatcgacccaagacgatgcctcaaaccggtaatattaactgatggcccagagagagtgatcctcgcgggcccgatccccgtcacgcccgcctcggccgctcagagacgtggcaggataggacgcaacccagcccaggaagacgatcagtatgtcttcagcggggacccactcaagaacgacgaggatcatgcgcactggaccgaggctaagatgctcctcgacaacatttacaccccggaaggaatcattcccacgttgttcgggccagaacgagagaagactcaggcaatagacggcgagttcagattacgtggggaacaaagaaaaaccttcgtagaactaatgcgccgaggagatttacccgtatggctcagctataaagtggcctcagccggaataagctacaaggacagagagtggtgcttcacgggggaacgaaacaaccagattctggaggagaatatggaagtagagatatggactagagagggcgaaaagaagaaactcagaccaaaatggctcgacgcgagagtatacgcagacccaatggccctaaaagacttcaaagagtttgcatccggccggaaatcaataaccctagacatactcacggagatagcatccctacctacctacctatcgtccagagctaaactggcgctagataacattgtcatgctccacaccactgaaagagggggcagagcatatcaacacgccctcaacgagttgcccgaaagtttagagaccctcatgttggtggcacttctgggcgctatgacagcgggaatattcttgtttttcatgcaagggaaaggaatcggcaagttgtcgatgggacttattaccatagcagtggcttcggggctcttatgggtagcggaaatccaaccccagtggatagcggcatctattatactggagttctttctaatggtactactgatcccagaacctgaaaagcagaggacgccacaagataaccagctcatctacgtcatcctgacgatattaactatcatcggactgattgccgccaacgagatgggactaatagagaagacaaaaaccgacttcggcttctaccaagtaaaaacagagacgacaatactagatgtggacctcagaccagcatcagcctggaccctgtacgccgtagcaaccacaatactcactcccatgctccgtcataccatagagaacacttcagcgaacctatccctggcagccatcgcgaaccaagctgccgtcctgatgggcctcggcaagggctggccactccaccgaatggacttgggagtacccttgctcgcgatggggtgttattctcaagtcaatccgaccacgctgactgcatctctagtcatgttactggtacactacgccatcattggaccagggttgcaagcgaaagcgacgagggaagcccagaaaagaaccgcagctggcataatgaaaaacccaacagtcgacggtataacagttatagacctagaaccaatcagctacgatccaaaatttgagaagcagctagggcaagttatgctactcgtactctgcgcgggccagctccttttgatgcgaacgacgtgggcattctgcgaagtgctgaccctagccaccggacctattcttacactttgggaggggaatccagggcgcttctggaacacaactatagccgtctccacggccaacatcttcaggggaagctacctcgccggcgcaggcctagcattctcccttatcaaaaacgcacaaacaccaagacggggcaccggaactgccggcgagacactcggagagaagtggaagaggcagctcaactccctagacaggaaggagttcgaagaatacaagaggagtgggatactggaagtagaccggaccgaagcgaaatcggcccttaaggacgggtcaaaaattaagcacgcagtctcacggggtagcagcaaaatccgatggatcgtggaacgcggtatggtcaagccgaagggaaaagtcgtggatctaggctgcggacgcggaggatggagctattacatggccaccctcaaaaacgtaacggaggtaaaaggatacaccaagggaggtccaggccacgaagaaccaataccgatggcgacatacggatggaatctggtaaagctccactccggagtggacgtattctacaaaccaaccgaacaggtcgacactcttctctgcgacattggcgaatcgtccagtaacccaacgatcgaagaagggaggacactgcgcgtattgaaaatggtcgaaccgtggctttcgagtaaaccagagttctgcataaaggtcctgaacccatatatgccgacagtaattgaagaactcgagaaactacaacggaaacacggaggtaacctggttaggtgcccactatcccgaaacagcacccacgaaatgtattgggtatcgggagcatccggaaacatcgtcagcagcgtcaacacaaccagtaagatgctccttaaccgcttcaccacacgtcaccgcaaacccacctacgagaaagacgtagatctaggcgctggcacccgctcagtcagcacagagacggagaaacccgatatgaccatcatagggcgaaggctgcagaggctacaagaagaacacaaagaaacgtggcactacgaccaagagaatccataccgcacctgggcctaccatggaagctacgaagcaccctctacggggtccgcatcatccatggttaacggtgttgtgaagctccttacgaagccttgggacgtcatccctatggtcacgcaactcgcgatgacagataccacacctttcggccaacagcgagtctttaaggaaaaagtggacacacgaactccccaaccgaagcccggcacccgaatggtaatgacaaccacagccaactggctctgggcgctactcggcaagaaaaagaaccccaggctctgcacacgcgaagagttcatctcaaaggtacgatcgaacgcagctataggggcggtcttccaggaagaacaaggctggacttccgcatcggaagcagtaaacgacagccgtttctgggaattggtggataaagagagagctttacaccaagaagggaaatgcgagagctgcgtctacaacatgatgggaaagcgcgagaagaaacttggtgaatttggaagggcaaaaggatcacgggcgatatggtacatgtggctgggggcgcgctttctggagttcgaggctttgggatttctgaacgaggatcactggtttggccgtgagaactcctggtcaggcgtagaaggcgaaggattacacagattgggatacatcctggaggagatcgacaagaaagatggcgacctaatgtacgcagacgacacagcagggtgggacacacgcataaccgaggatgacctacaaaacgaagaattaatcacagagcaaatggcaccccaccataaaatcctcgccaaagctatattcaaactaacgtatcaaaacaaggtcgtaaaagttcttagacccactccgcggggagcggtgatggatattatctctaggaaggaccaaaggggcagcggacaagtcggcacctatgggctgaacacattcacgaacatggaggtgcaactaatacggcagatggaggcagaaggcgtcataacacaagatgatatgcaaaacccgaagggactaaaggagagagttgagaagtggctacgggaatatggcgttgaccgcctgaaaaggatggccatctcaggggatgattgcgtggttaaaccgctcgacgagcgcttcggcacctccttgcttttcctaaacgatatgggcaaagtacggaaggacatacctcagtgggagccaagcaaaggttggaagaactggcaagaagtcccattttgctcgcaccacttccacaagatcttcatgaaagacgggcggtcgctcgtcgtcccttgtcgtaaccaggacgaactaatagggcgcgctagaatatcccagggggcgggctggtctctaagagaaaccgcatgtcttggcaaggcatatgcccaaatgtggagcctaatgtacttccaccgtagagacctaagactagcgagcatggccatatgctcagcagtgccgaccgagtggtttccaacatcaagaaccacgtggagcatccatgcccaccatcaatggatgaccaccgaagacatgctaaaggtgtggaatcgggtgtggatcgaagacaacccgaacatgatcgacaagacgccagtccacagctgggaggacatcccctacctaggcaagcgagaagatctatggtgcggcagcctaatcgggctgagttcaagggcaacatgggcaaagaacatccacacagccattacccaagtccgcaatctaattgggaaagaagaatacgtagactacatgccagtcatgaaacggtactcagcaccgtctgagtcagaaggcgtcttgtaa

SEQ ID NO: 26320 - RNA, 9867 nt, synthetic construct
  misc_feature 1..9867: note = derived and/or modified CDS sequence (opt11) from DENV-4__KJ596670__SS-prME
  source 1..9867: mol_type = other RNA
agtaccattaccctcctatgcctgatcccgactgtaatggccttccatctttccactcgcgatggcgaaccgctcatgatagtggcaaagcacgaacgggggcgccccctgctgttcaaaaccaccgaaggtatcaataagtgcacgctcatcgcgatggacctgggggaaatgtgcgaggacacagtgacatacaagtgtccactgctcgtgaataccgagcccgaagacatcgactgctggtgcaacctgacgtccacctgggtcatgtacggcacatgcacccagtccggggaacggcgccgcgaaaagcgcagcgtggcactgacgcctcattccgggatgggccttgagacccgggccgaaacttggatgagctccgagggggcctggaagcacgcccagcgagttgagagctggatcctgcggaaccccggcttcgctctgttggcagggtttatggcatacatgatcggccagactgggatccagcggacagtcttcttcgttctgatgatgctggtagccccctcctatggcatgcggtgcgtcggcgtggggaaccgcgacttcgttgagggagttagcgggggagcgtgggtggatctcgtgttggagcatggcgggtgtgtcaccaccatggctcaggggaagcccacccttgacttcgagctcaccaagacgactgccaaggaggtggccctgctgaggacttactgcatcgaggccttgatttcaaacatcacgacagcgacccgctgcccgacccaaggggagccttacctgaaggaggagcaggatcagcaatacatctgcagacgagacgtcgtcgaccgggggtgggggaacggatgtggcctgtttggtaagggaggggtggtcacttgcgccaagtttagctgctccgggaagattactgggaacctcgtgcagatcgagaacctggagtacaccgtggtggtgaccgtgcataatggcgacacgcacgcggtcggcaacgacacaagcaatcacggcgtgaccgccaccatcacgccccggagcccctcagtggaggtgaagctgccggactacggcgagctcaccttggactgtgagccccggtcagggatcgatttcaacgagatgatactaatgaagatgaagaaaaagacctggctcgtgcacaagcagtggttcctggaccttcccttgccgtggaccaccggcgccgacacgagcgaggtccactggaactacaaggagcgcatggtcaccttcaaagtgccgcacgcgaagcggcaagatgtgaccgtgctgggttctcaggaaggcgccatgcacagtgccttagccggtgccacagaggtcgactccggggacggcaaccacatgttcgcggggcacctcaagtgcaaggtccgcatggagaagctgcgtatcaagggcatgtcgtacacgatgtgcagcgggaaattctccatcgataaggagatggccgagacccaacatgggaccaccgtagtgaaagtgaagtacgagggcgccggggccccctgcaaggtccccatcgagatccgtgacgtaaacaaagagaaagttgtcggtcgggtgattagtgccacgcctctggctgaaaacactaacagtgtaacaaacatcgagctcgagccacccttcggggacagctacattgtcataggggtaggcaacagcgccctgaccctacactggtttcggaaggggagttccatcggcaagatgttcgagagcacctatcgcggggccaagcggatggccatactcggcgagaccgcgtgggatttcgggtcagtaggtggcctcttcacgtcgctggggaaagccgtccatcaggtcttcgggtcagtgtacacaacgatgttcggaggggtcagctggatgattcgcatactgatcgggttcctggtcctttggataggcaccaatagccgtaacacctcaatggccatgacctgcatcgcagtgggagggatcacgctgttcttagggttcaccgtccaggcggacatgggctgcgtagtgtcctggagcggtcgcgagctgaaatgtggatccggcatcttcgtcgtggataacgtacacacctggaccgagcagtacaaatttcagcccgagagccccgcacgtctggctagcgcaatcctcaacgcccacaaagatggggtctgcgggatccgctcgacaacacggctagaaaacgtgatgtggaaacagataacaaatgaactaaactacgtgttatgggagggcgggcacgacctgaccgtagtcgccggcgacgtgaagggcgtcttaaccaaggggaagcgggcgctcaccccgcctgccagcgaccttaagtactcctggaagacctggggcaaagcgaagatattcacccccgaggcccgtaatagcaccttcctcattgatggccccgacacatcagaatgtccgaacgaacgccgcgcctggaatagcttcgaggtggaggactacgggttcgggatgttcactaccaacatatggatgaagttccgggagggttccagcgaggtgtgcgatcaccgccttatgtctgcggccatcaaggaccagaaggccgtacatgcggacatgggctattggatcgagtcctctaagaaccaaacgtggcagattgagagagcgagccttatcgaggtaaagacttgcctgtggcccaagacccacaccctatggtccaacggggttctagaatcgcagatgctgatccccaaatcctacgccggcccgtttagccagcataactatcgacaggggtatgccacccagacggtcggcccctggcacctcggaaagttagagatcgattttggagagtgcccaggtaccaccgtgaccatacaggagaattgtgaccaccgcgggccgtccttgcgtactaccaccgcgtcgggcaagctcgtaacccaatggtgctgccgcagctgtacgatgccgcccctgcgtttcctgggggaggacggttgctggtatggtatggagatacggcccctctccgaaaaggaggaaaacatggtcaaaagccaggttacggccggccagggcacctctgagaccttcagtatgggcttactgtgcctcacattattcgtcgaggagtgcctgagacggcgcgtgacccggaagcatatgatcctagcagtagtaatcactctgtgcgccattgttctaggcggtctaacctggatggacttgttacgcgcactgatcatgctgggcgacacgatgtccggaaggattggcggccagacccacctggccatcatcgctgtgtttaaaatgtctccaggttacgtcctcggtgtgttccttcgcaaactaacatcccgggagaccgctctcatggtgatcggaatggcgatgacgactacgctgtcgatcccccacgacctgatggagcttatcgacgggatctccctggggctgatacttctgaagatcgtcacccagttcgataacacccaggtggggaccctggcactcagcctcaccttcatccgctcgaccatgtcactggtgatggcctggaggacgatcatggcggtcctattcgttgtgacgctgatcccgctttgccgcacctcatgcctccaaaaacaaagccactgggtagagatcacggcgcttatcttgggggctcaggcactgcccgtgtacctcatgacgttaatgaaaggggcatcgcgtcgcagctggccactcaacgagggcatcatggcggtggggctggtctccctactcggctcggctttactgaagaacgacgtgccgctagccgggccgatggttgccgggggtctgctgctcgcagcgtacgtcatgtccgggtccagcgctgacctgtccctagagaaggccgcgaacgtgcaatgggacgagatggccgatatcaccggctcgtcgccgattatcgaggtgaaacaagacgaggacgggagcttctccattcgggacgtagaggaaaccaatatgataacactcttggtgaagctggcgctcatcacggtgagcgggctgtaccccctggcaatccctatcactatgaccctctggtacatgtggcaagtgaagactcagcgctcaggcgccctgtgggacgtgcccagccccgccgcaacccagaaggcggccttgtccgagggagtgtatcggatcatgcagagaggccttttcggcaaaacgcagataggcgtagggatccacatggagggcgtctttcacaccatgtggcacgtgaccaggggctcagtaatctgccacgagacaggccgcttggaacccagttgggccgatgttcgcaacgacatgatcagttacggcgggggttggcggctgggtgacaagtgggacaaggaggaggacgtacaagtccttgccatcgagccagggaagaaccccaagcacgtccagacaaagcccggattgttcaaaaccctgaccggagagatcggcgcagtaaccttagactttaagccagggacgtcagggagcccaatcatcaatcgaaagggcaaggtcatcggactgtacggcaacggcgtcgttaccaagtccggcgactacgtcagcgcgattacccaggccgagcggatcggggagcccgattacgaggtggacgaggacatcttcaggaagaaacggctgacgatcatggacctccaccctggcgccgggaagacgaagcgcatcctcccctctatcgtacgggaggcgttaaagcgccggctgcgcaccctcatcttagcccccacacgtgtcgtggccgccgagatggaagaggcgctgcgcggcctcccgatacggtaccagacccccgcggtgaagtcagagcatacgggccgtgagatcgtcgacctgatgtgccacgcaaccttcaccacccggctgctctccagcacgcgcgtaccgaactataacctaatagttatggatgaggcccacttcaccgatccaagctctgtcgctgcccggggctatatctccacccgcgtggagatgggcgaggccgcggcgattttcatgaccgccacgccgcccggagccactgacccctttccccaatccaacagcccgatcgaggacatagagcgggagatccccgagagatcctggaacacagggttcgactggatcaccgactaccagggaaaaacggtctggtttgtgccgagcattaaggcgggaaacgatatcgctaactgcctgcgcaaatcaggcaagaaggtgattcagctaagtcggaaaacctttgacaccgagtatccaaagacaaagctaacagactgggacttcgttgtgaccacagacatcagtgagatgggggccaatttccgcgccggccgcgtgatcgacccccgccggtgcctgaagccggtcatcctcacagacgggccggagcgagtgatcttagccggccccatccccgtaacgccggcaagcgccgcccaacggcgcggcaggatcgggcgtaaccctgcccaggaggacgaccagtacgtgttttccggcgatcccctgaaaaatgacgaggatcacgcccattggaccgaggccaagatgttgctagacaacatctacaccccagagggcatcatccccacccttttcgggccggagcgggaaaagacgcaggccattgatggcgagttccgattgagaggcgaacagcgcaagaccttcgtggagctgatgaggcgcggcgacctccccgtgtggttgagctacaaggtcgcctccgctgggatcagctacaaggaccgggagtggtgcttcaccggcgagaggaacaaccagatccttgaagagaatatggaggtggagatctggacccgggaaggggagaaaaagaaactccgtcccaagtggctcgacgctcgggtgtacgcggatcccatggccctgaaagacttcaaggagttcgccagcggcagaaagagcatcactcttgacatcctcaccgagattgcctccttaccgacctacctcagctcacgcgcaaagctcgcgctcgacaacattgtgatgctccacaccaccgagcgcggagggcgcgcctaccagcatgccctcaacgagctgccagagtcgttggaaacgcttatgctagtagcgctgctcggggctatgaccgccgggatttttctgtttttcatgcaggggaaaggaattggcaagctgtcaatgggcctcattaccatagcagtggcctccggtctgctgtgggtcgccgagatacagccgcagtggatcgcggctagcattattttagagttcttcctaatggtgcttttaataccagagcccgaaaagcagagaacaccccaggataaccagttgatctatgtgatactaacgatcctcacgataatcggactgattgcggccaacgaaatggggctgatcgagaagaccaagaccgactttggcttctaccaggtcaagacagagaccaccatactcgatgtggatctgaggccggcctcggcgtggaccctgtatgccgtggcgactaccatactcacccccatgctgcggcacacaattgaaaacactagcgcaaacttgtccctcgctgcgatcgcgaaccaagccgccgtcctgatggggttggggaagggctggcccctccaccgcatggatctgggggttcccctgctcgccatgggctgctacagtcaggtcaaccccaccacgctgaccgcatccctcgtgatgttgctggttcattatgcgataatcgggccgggcttgcaggccaaggcaactagagaagctcagaaacgcaccgcggccggaattatgaagaaccccaccgtcgacggtatcaccgtaatagacctagagcccattagctacgaccctaagttcgagaaacagcttggtcaggtcatgctcctcgtgctatgcgccgggcagttgttgctgatgcgcacgacgtgggccttctgcgaggtccttaccctcgcaaccggccccatcctgacgctgtgggagggcaacccgggcaggttttggaacaccaccatagctgtatccaccgcaaatattttccgcggcagctacctggccggggctggactcgcgttctccctgatcaaaaacgcgcagacgccccgtcgggggacgggcaccgcgggcgaaaccctcggcgaaaagtggaagcgccaactgaactccctagaccggaaggagttcgaggagtacaaacggagtggcattctcgaggtggaccggaccgaggccaagagcgcattgaaggacgggtccaagataaagcacgcggtctcgcgcggatcctcaaaaataaggtggatcgtggagagaggcatggtgaagcctaaaggcaaggtcgtagacctagggtgcggccgcggtggatggagctactatatggcaacgctaaagaacgtgaccgaggtcaagggttacaccaaaggagggccaggtcatgaagaacccatccccatggccacctatggttggaacctggtgaagttgcacagtggcgtggacgtattctataagcccacggaacaggtggacaccttactatgcgacatcggggagagctcatctaacccgaccattgaggagggccggaccttgcgcgtcctcaagatggttgagccctggttatccagcaaaccagagttctgcataaaggtattaaacccctacatgcctactgtgattgaggagctggaaaagctccagcggaagcacggtggaaacctggtgcgatgccctctgagcagaaattccacacacgaaatgtactgggtgtctggcgccagcgggaacatcgtctccagcgtaaacaccactagcaaaatgctcctgaaccgcttcacaacccggcatcgcaagcccacctacgagaaggacgtcgacctgggcgcggggactcgaagcgtatctacggagatcgaaaagcccgacatgaccatcatcggccgccgactccagcgcctgcaggaggagcacaaagagacctggcattacgatcaggaaaacccctacagaacgtgggcctatcatggtagctatgaggcaccctctacgggaagcgcgtcgtcaatggtgaacggggtggtcaagctgcttacaaagccctgggacgtgatccccatggtcactcaactagccatgacagacacgacgcccttcgggcaacagcgtgtcttcaaggagaaagtggatactcggacgccccagccaaaacccggcacgcgcatggtgatgaccaccacagctaactggctatgggccctcctagggaagaagaagaaccccaggttatgcacgcgtgaggagtttatttcgaaggtccggtcgaatgccgccatcggcgccgtctttcaggaagaacaggggtggacctcggcgtccgaggcggtcaacgacagccgcttctgggagctcgtcgataaggagagagctttgcatcaggagggtaaatgcgagtcgtgcgtttataacatgatgggtaagcgggagaagaagctgggggagttcggccgcgccaaagggagccgggccatctggtacatgtggcttggtgcgcgcttcctggagttcgaagccctggggtttttgaacgaagatcactggttcggccgtgaaaactcgtggagcggcgtggagggtgagggcctgcatcgcctgggatacattctcgaggagattgataagaaggacggcgacctgatgtatgccgacgacaccgctggctgggacacccgaatcacggaggacgaccttcagaacgaggagctaatcacagagcagatggctccccaccacaaaatcctggctaaggctatcttcaagttaacctatcagaacaaggtcgtcaaagtcctccgccctacacctcggggtgccgtcatggatattataagtcgcaaggatcagcggggaagcgggcaggtaggaacgtacggactgaacacattcacgaacatggaggtacaactgataagacagatggaggccgagggagtgatcacacaggacgacatgcagaaccccaaaggcctcaaagagcgtgtggaaaaatggctgcgcgagtgtggggtagaccgtttgaaacgcatggcaatctccggagacgactgcgtcgtaaagcccctcgacgagcgcttcgggacaagtctgttattcctgaatgacatgggcaaggtgcgcaaagacattccccagtgggagccctctaaagggtggaagaattggcaggaggtgcccttctgcagccaccacttccacaagatctttatgaaagatggacggtccctggttgtcccctgtcgcaaccaggacgagctgatcggccgggccagaatctcccagggggcgggctggtcgctcagagagacggcctgcctagggaaggcctacgcgcagatgtggtctctcatgtactttcaccggcgcgacttgaggctcgcttcgatggccatctgttcagccgtccccactgaatggttcccaaccagccgcaccacgtggtccatccacgcacaccaccagtggatgacaaccgaggacatgctgaaagtgtggaaccgggtgtggattgaggacaatcctaatatgattgataagacccccgtccacagctgggaagacatcccttacctcggcaagcgcgaggacctttggtgcgggtccctgattgggttatcttctcgggctacatgggccaaaaatatccatacagccatcacccaggtgaggaaccttatcggcaaagaagagtacgtggactacatgtctgtcatgaagcgttactctgccccgagcgaatccgaaggggtgctgtga

SEQ ID NO: 26321 - RNA, 9867 nt, synthetic construct
  misc_feature 1..9867: note = derived and/or modified CDS sequence (opt11) from DENV-4__KJ596671__SS-prME
  source 1..9867: mol_type = other RNA
agcactatcaccctgctatgcttgatccccacggtgatggcattccacttgtctacgcgggacggcgaacctctcatgatcgtcgctaagcacgagcgggggcgccccctgctgtttaagaccaccgagggcatcaacaagtgcacgctcattgcgatggacctgggagaaatgtgtgaagataccgtgacctataagtgccccctgctagtgaacaccgagcctgaagatatcgactgctggtgtaacttgacgagcacctgggtcatgtacggtacctgcacccagtccggggagcgtcgccgcgagaagcgcagcgttgccctgacgccgcactccggcatgggcctcgagacgcgggccgagacctggatgagcagcgagggggcctggaagcacgcccagcgcgtagaaagctggatcctgcggaacccgggcttcgcgctgcttgctggtttcatggcatatatgataggccagaccggtatccagcgcacggtcttcttcgttctcatgatgctggtggcaccctcctacggaatgcgatgcgtcggcgtggggaatcgcgacttcgtggaaggcgtcagcgggggcgcgtgggttgacctcgtgctggagcatggcgggtgtgttaccacgatggctcagggcaagcccaccctggactttgagctcaccaagaccaccgccaaggaggtggccctgctgaggacctactgcatcgaggccctcatcagtaacattacgaccgcgacgaggtgccctacgcagggggaaccttaccttaaggaggagcaggaccagcagtacatctgccggcgcgacgtggtcgatcggggctggggcaacggatgcggcctattcggcaaaggaggggtcgtgacgtgtgcaaagttcagctgcagcgggaagatcaccggtaacttggtccagatagagaatctggagtacaccgtggtggtcaccgtgcataacggcgacacgcacgccgtcggcaacgacaccagcaatcacggggttaccgcaaccatcaccccgcgctcgcccagcgtggaggtcaagctgcctgactacggcgagctcacgctggactgcgagccacggtccgggatagacttcaacgagatgatcttgatgaaaatgaagaaaaagacctggctcgtgcataagcagtggttcttggatctgcccctcccgtggacgaccggcgccgacacgagcgaggtccactggaactataaagagcggatggtcaccttcaaggtgccgcacgccaagcggcaggacgtgacggtcctggggtcccaggagggcgccatgcacagcgccttggccggcgctaccgaggtggacagcggggacggcaatcacatgttcgcgggacacctcaaatgcaaggtgcgcatggagaaactgcgcatcaagggcatgtcctacacgatgtgcagcgggaagttcagtatcgacaaagagatggcagaaacgcagcacgggaccaccgtcgtgaaagtgaagtacgagggagccggagccccctgtaaggttcccatcgagatcagagacgtcaataaagaaaaagtggtcgggcgcgtgatctcggccacacccctggcggaaaataccaactccgtgactaacatcgagctggaaccgccctttggggattcgtacatcgtaatcggagtgggcaactctgccttaaccctacactggttccgtaaggggtcgtccatcggcaagatgttcgaaagcacctaccgcggggccaaacggatggccatcctcggcgagaccgcgtgggacttcgggtccgtgggcggcctgttcacctctctggggaaggccgtccaccaagtgtttggcagtgtatataccacgatgttcgggggtgtcagctggatgatccgtatcctcatcggcttcctggtactgtggatcggcaccaactcccggaacactagcatggccatgacctgcatcgccgttggcgggatcactttgttccttggcttcaccgtacaggctgacatggggtgtgtggtgtcctggagcggccgggagttaaagtgcgggtccggaatatttgtagtcgacaatgtgcacacttggaccgagcagtataaattccagcccgagtcccccgcgagactggccagcgcgatactcaatgctcacaaggatggcgtatgcggtatccgcagtacgacccggctggagaacgtgatgtggaagcaaatcaccaacgagctgaactacgtgctctgggagggcgggcacgacctgaccgtggtcgcgggcgacgtgaagggcgtcctgactaagggtaagcgagcgcttacaccacccgcctctgacctgaagtactcttggaaaacctggggcaaggccaagatcttcacccccgaggcccggaacagcacgttcctgatcgacgggcccgacacctcagagtgcccgaacgagcgccgggcctggaacagcttcgaggtggaggactacggcttcggaatgtttaccaccaatatctggatgaagttccgcgagggctcctcagaggtgtgcgaccaccggctcatgagcgctgcaatcaaagatcagaaagccgtccacgccgacatgggctactggatcgagagcagcaaaaaccagacgtggcaaatcgagcgcgctagcctgatcgaggtgaagacgtgtctgtggcctaagacgcacaccctgtggagtaacggggtgttggagtcccagatgttgattccaaagtcctacgccggcccgtttagccagcacaactaccgacaggggtacgccacccagacggtaggtccatggcacctcggtaagctggagatcgacttcggcgagtgccccggaaccaccgtgaccatccaggagaattgcgatcaccgcgggccttccttgcgcacgaccaccgccagcggcaagctcgtgacccagtggtgctgccggagctgcaccatgccgccgctgcgcttcctcggggaagacggctgttggtacgggatggagatacggcccttgtccgagaaggaggagaacatggtcaaaagccaggtgaccgccggccagggcacctccgagacttttagcatggggctcctgtgccttaccctgttcgttgaggagtgcctgagaagacgcgtgacccggaagcacatgatcctcgcggtggtcatcaccttgtgcgccatcatccttggagggctcacatggatggatctgctgagagctctgatcatgctgggtgacaccatgtccggccggatcggaggccagacccacctcgccatcatcgccgtattcaagatgagccccggatatgtgctcggcgtctttctgcgtaagctgacctcccgagaaacggccctcatggtgatcgggatggcaatgacgaccaccctgagcatcccgcatgacctgatggagctcatcgacggaatcagcctgggtctgatccttctgaagattgtgacccagttcgacaacacgcaggtcgggacccttgccttaagcctgacctttatccgctccacgatgtccctggtgatggcctggcggacgatcatggccgtgctctttgtcgttaccctcatccccttatgccggacaagttgcctgcagaagcagtcacactgggtggagatcaccgcgctgatcctgggagcccaggccctccccgtatacctgatgacgctgatgaaaggggcctcccggagaagttggcccctaaacgagggcatcatggctgtggggctagtaagtctcctcggatccgccctcctaaagaacgacgtacccctagccggccccatggtggccgggggcctcctgctcgccgcgtacgtaatgtccggatccagcgctgatctgtccttggagaaggctgcgaacgtacagtgggacgagatggccgacataaccggcagctcccccatcatcgaggtgaagcaagatgaggatgggagcttctccatacgggacgttgaggagactaacatgatcaccctcctggtcaaactggctttgatcacggtgagcggcctgtatcccctagccatcccgattacaatgactctgtggtacatgtggcaagtgaagacccagcgctcgggagccctgtgggacgtcccatcccccgcagccacccaaaaggcggcactgtccgaaggggtgtacaggattatgcagcgtggcctcttcgggaagacacaggtgggcgtgggcatccacatggagggcgtattccacaccatgtggcacgtcacccggggcagcgtaatctgccacgaaaccgggagactggagccttcctgggccgatgtccggaacgacatgatcagctacggcgggggatggcgtctgggagacaagtgggataaagaggaagacgtgcaggtcctcgctattgagccggggaagaaccccaaacacgtgcagactaagcccggtctgttcaagaccctgaccggggagattggggcagttaccctcgactttaagcccggaacgtccggatctccgatcatcaatcgcaaaggaaaggtcatcgggctgtacggcaacggcgttgtgactaagtccggcgactatgtaagcgcgatcacccaggccgagcgtatcggggaacctgactacgaggtggacgaggacattttccgcaagaagcgcctaacaatcatggacttacacccgggcgccggcaagacgaagcgcatactgccctcaatcgtgcgggaagccctaaagcgccggttgagaaccctaatcctggccccaacccgggtcgtggcagccgaaatggaggaggccctgcgtgggttgcccatccgctaccaaacccccgccgtgaaaagcgagcacacgggcagagagatcgtcgacctgatgtgtcacgcaaccttcaccacccggctgctgtccagtacgcgcgtgccgaactacaatctgatcgtaatggacgaagcgcacttcacggaccccagctccgtcgccgcccgggggtacatcagcacccgcgtggaaatgggtgaggcagctgccattttcatgaccgccacgccgccgggtgctaccgacccgttccctcagtccaacagcccaatcgaggacatcgagcgagagattcccgagcgatcctggaacacgggattcgactggatcacagactaccagggcaagacggtctggtttgtgccgagcatcaaagccgggaacgacatcgcgaactgcctgcgcaagtccgggaagaaggtaatccagctgagccggaagaccttcgataccgagtaccccaaaaccaaactgacggactgggacttcgtcgtgaccaccgacatctccgagatgggggcgaactttcgcgctggccgggtgatcgacccccgcagatgcctgaagcccgtcatcttaacagacgggccggagcgcgtgatcctagccggcccgatccctgtgactcccgcgagcgccgcccagcgtagaggccggatcggacgcaacccagcccaagaagacgaccagtacgtattttccggggacccgttgaagaacgacgaggaccacgcacactggaccgaggcgaagatgctcttagacaacatctataccccggaggggatcatccccaccctgtttggcccagaacgggaaaagacgcaggctatagacggcgagttccgcctcagaggggaacagcgcaagaccttcgtagaactcatgcggcgcggcgacctgcccgtgtggctcagctataaggtcgcgtccgctgggatcagctataaggaccgggaatggtgcttcaccggcgaaaggaacaatcagatcctggaggagaacatggaggtggaaatctggacccgtgagggggagaaaaagaagctgaggccaaagtggctcgacgcccgtgtttacgcggaccccatggcattaaaggattttaaggagttcgcctccggccgcaagtcgatcacactggacatccttaccgagattgcctccctgccgacctacctgagtagccgcgccaagctggcactggacaacatcgtcatgctgcacaccaccgaacggggcggtcgcgcctaccagcacgccctcaacgagctgcccgagtcactggagactctcatgttggtggcacttctcggcgccatgaccgcaggaatcttcctgttcttcatgcaaggcaaggggatcggcaagctgagcatgggtctcatcacaatcgccgtcgcctccgggctgctgtgggtagctgagatccagccccagtggatcgccgcctcgataatcctcgagttcttcctgatggtgcttctcataccggagcccgaaaagcagcggactccccaggacaaccagctgatctacgttatcctgacgatcttaaccataatcggcctgatcgccgctaacgagatggggctgatcgagaagaccaagacagatttcgggttctaccaagttaaaacggaaaccaccatcctcgacgtggacttgcgcccggcatctgcgtggacgctctacgccgttgcgacgacgatcctcactccgatgctgcggcacaccatcgagaacacgagcgcaaacctgtcgctcgccgcaatcgccaatcaggccgccgtcctcatgggcctgggaaaaggctggcccctccaccgcatggacctgggggtgcctctgctagccatggggtgttacagccaggtaaaccccaccaccctgactgcgtccctggtgatgctcctggtgcattatgccatcattgggccgggcctgcaggcaaaggccacgcgggaggcgcagaagcgcaccgctgccggcatcatgaagaacccgaccgttgacgggatcaccgtaatcgacctcgaacctatcagctacgatcccaagttcgaaaagcagctgggccaagtaatgctgctcgtgctctgcgcggggcagctgcttctgatgcggaccacctgggccttctgcgaagtcctgacactggctaccggcccgatcttgacgctgtgggaagggaaccccggccgcttctggaacaccacgatagccgtgtccacggccaatatctttcgggggtcttacctcgcaggcgccggcctggcgttctccctgataaagaacgcccaaacaccccgacggggcaccgggaccgctggggagaccctcggcgagaaatggaagcgccagctgaacagcctggatcgcaaggagttcgaggagtacaagcgctctggcatcctcgaggtggacagaaccgaggccaagagcgccctgaaggatgggtccaagatcaagcatgcggtctcccgcggctccagcaagatccggtggattgtggagcgcgggatggtgaagcccaagggcaaggttgtggacctggggtgtggccgaggcgggtggtcctactacatggccaccctcaagaacgtgaccgaggtcaagggatacacgaaagggggcccgggccacgaagaacccatccccatggccacatacggctggaacttggtcaaactgcatagcggcgtggacgtcttctacaagcccactgagcaggtagacaccttactttgtgacatcggggagagctccagcaacccgaccatcgaggagggccggacgctacgcgtgctcaagatggtcgagccatggttgtcctcaaagcccgagttctgcattaaagtgcttaatccctacatgccgactgtgatcgaggagctggagaagctccagaggaaacacgggggcaacctggtccgttgccccctgtcccggaacagcacccacgaaatgtactgggtatccggcgccagcgggaacatagtcagtagtgtgaacaccacctcgaagatgctcctgaaccgattcacgacgcggcaccgcaagccaacctacgagaaagacgttgatctaggcgcgggcactcggagcgtctctacggagatcgagaagcccgacatgaccatcataggacgccggctgcagaggctgcaagaggagcacaaggagacatggcattacgaccaggagaatccgtatcggacctgggcctaccacggcagctacgaggccccatccacgggcagcgcctccagcatggtgaatggagttgtcaagctgcttacgaagccctgggacgtgatcccgatggtgacgcagctggccatgaccgatacgactcccttcgggcaacaacgcgtgttcaaggagaaggtggatacccggacaccccagcccaagccggggacgcgcatggtgatgaccaccaccgccaactggctgtgggccctcctggggaaaaagaagaacccccgcctatgcacgcgcgaggagttcatttccaaggtccggagcaacgccgcgataggcgccgtgttccaggaagaacagggatggactagcgcttccgaggctgtgaacgactcccgcttctgggagctcgtcgataaggagagggcactgcatcaggagggcaaatgcgagtcctgcgtgtacaacatgatgggcaaacgcgagaagaagctgggggaatttggccgagcaaaggggagtcgtgccatctggtacatgtggttaggcgcgcggttcctggagttcgaggcgctggggtttctcaacgaggaccactggttcgggagagaaaattcctggagcggcgtagagggggagggcctgcatcgcttggggtacatcctcgaggagatcgacaagaaggacggcgaccttatgtacgccgacgacaccgccggctgggacacccgcattactgaggacgacctgcaaaacgaggaactcatcaccgagcagatggcgccccaccacaagatccttgccaaggccatcttcaagctgacctatcagaacaaggtcgttaaggtgctccgcccgacaccccggggcgccgttatggacatcatatcacgaaaggaccagcggggcagcggtcaggtcggcacgtacgggttgaacacgttcaccaacatggaggtgcagctgatccgacaaatggaggccgaaggcgtcatcactcaggacgacatgcagaaccccaagggcctcaaagagcgggtggagaagtggctgcgtgagtgtggggtggatcggctgaagcgcatggcgatctccggcgacgactgtgtcgtgaagcccctcgatgagcggttcggtaccagcctgctgttccttaacgacatgggtaaggtcagaaaggatatcccccaatgggagccgtccaaagggtggaaaaactggcaggaggtcccattttgtagtcaccatttccacaagatcttcatgaaggacggccggtccctggtggtgccgtgccgcaaccaagatgaacttatcggcagggctagaatcagccagggtgccggatggtccttgcgcgagactgcctgcctggggaaggcatacgcgcagatgtggtctctgatgtacttccaccgacgcgacctccggctggcctccatggccatctgttctgcagttcccactgagtggttcccgaccagccgcaccacgtggtccatccacgcccatcaccagtggatgacaactgaggacatgttaaaagtttggaaccgggtgtggatcgaggacaaccccaacatgattgacaaaactcccgtccacagctgggaggatatcccctacttgggcaagcgcgaggatctgtggtgtgggtccctaatcggcttgagctctcgggcgacgtgggccaagaacatccacaccgcgatcacccaggtacgcaacctgatcggcaaggaggagtatgttgactacatgagcgttatgaagcgctactccgccccgtctgagtccgagggtgtgctgtga

SEQ ID NO: 26322 - RNA, 9867 nt, synthetic construct
  misc_feature 1..9867: note = derived and/or modified CDS sequence (opt11) from DENV-4__KJ579241__SS-prME
  source 1..9867: mol_type = other RNA
agcacgatcacgctgctctgcttgatccccacggtgatggccttccatctgtccactcgcgacggcgaaccgctcatgattgtcgctaagcacgagcgggggcgtcccttactgttcaagacgaccgaaggcatcaataagtgcacgctcatagccatggatttaggggagatgtgcgaagacaccgtgacctacaagtgtcccttactcgtgaataccgagcccgaggacatcgactgttggtgcaacctcacgtcaacttgggtcatgtacggaacctgcacccagtccggagagaggcgccgtgagaagcgctcggtggccctcacgccgcattcaggtatgggcctggagacccgggccgagacctggatgtcgtccgagggggcctggaagcacgcccagcgcgtggagtcatggatcctgaggaatccgggtttcgcgctgctcgccggattcatggcttatatgatcggccagaccgggatccaacgtacggtgttctttgtgttgatgatgcttgtggccccctcctatggcatgcggtgcgtcggcgtggggaaccgcgacttcgtggagggcgtgagcggaggagcgtgggtggatctcgtcctggagcacggcggttgcgtcaccaccatggcccagggcaagcccacgctggacttcgagttaactaagaccaccgccaaggaggtggcgctgctgcggacttactgcatcgaggcccttatatccaatatcacgaccgccacccgctgccccacgcagggcgagccgtaccttaaggaggagcaggaccaacaatacatttgccgccgcgacgttgtcgaccgtggctgggggaacggctgcggcttattcgggaagggcggggtggtcacgtgcgcaaagttcagctgctccggcaagatcaccgggaacctcgttcagatagagaacctggagtacaccgtggtcgtcaccgtgcacaacggcgatacgcacgcagtaggcaatgacaccagcaaccacggggtgactgcgaccatcacgccccgttccccctctgtggaggtcaagttacctgattacggggagctcaccctggactgcgagccgcggtccgggatcgatttcaacgagatgattttgatgaagatgaagaagaaaacctggctcgtgcacaagcagtggttcttagacctgcccttgccctggaccaccggcgctgatacgagcgaggtgcactggaactataaggagcgcatggtcacctttaaaatcccgcatgcgaagaggcaggacgtgactgtccttggatcgcaggagggagccatgcacagcgccctggccggagccaccgaggtcgacagcggagacggcaatcacatgttcgcggggcacctcaagtgtaaagtgcgcatggagaaactgcgcatcaagggcatgtcctacacgatgtgcagcggcaaattctccatcgataaggagatggccgagacccagcacggcaccacagtggtcaaggtgaagtacgagggcgccggggcgccctgtaaggtccctatcgagattcgtgacgtcaacaaggagaaggttgtgggccgcgtcatatcggccacacccctggcggagaacaccaactccgtgacgaacatcgagctcgagcctccgttcggggacagctacattgtgatcggcgtcggcaactccgccctgaccctgcactggttccggaagggcagctcgatcgggaaaatgtttgagagcacgtaccggggagccaaacgtatggccattctgggcgagaccgcgtgggatttcgggtccgtgggcggcctgtttacctccctgggcaaggccgtgcaccaggtcttcggctccgtgtacaccacgatgttcggcggcgtgtcctggatgatccgcattctcattggcttccttgtcttatggattggtaccaactcccgcaacaccagcatggctatgacatgcatagctgtcggcgggatcacgctgtttctcggctttaccgtgcaagccgacatgggatgcgtcgtgagttggtcaggccgcgagctgaagtgcgggtccggcatcttcgtagtcgataacgtgcacacctggaccgagcaatacaagttccagcccgagagccctgcacggctggccagcgccatcttaaacgcgcataaggacggcgtgtgtggaatacgctccacgacccggctggagaacgtcatgtggaagcaaattaccaacgagctgaactacgtgctctgggagggcgggcacgacctgaccgtagtcgccggggacgtaaaaggggtgctcaccaaaggtaagcgcgcgttaactccgcccgccagcgacttgaagtacagttggaagacctggggcaaggctaagatcttcacccccgaggcccggaactcgaccttcctgatagacgggcccgacacctccgagtgcccaaacgagagacgggcctggaacagcttcgaggtcgaggactacggcttcgggatgtttaccaccaatatctggatgaagttccgcgaaggcagctcggaggtgtgcgaccaccggcttatgtctgctgctatcaaagaccagaaagccgtgcacgccgacatgggttactggattgagtcctccaagaaccagacctggcagatcgaacgcgcgtctctgatagaggtcaagacctgcctgtggccaaaaactcacaccttgtggtccaacggggtactcgagtctcagatgctgatccccaagtcctatgccggtccattcagccagcacaactaccggcaggggtacgccacccagacggtgggcccctggcacctagggaagctggagatcgactttggcgaatgccccggcaccacagtcaccattcaggagaactgcgaccaccgcgggccctccctccgcacgaccaccgccagcggcaagctcgtaacccagtggtgctgccggtcgtgtacgatgccgccccttcgcttccttggggaagacgggtgctggtacggcatggaaatccggcccctttccgagaaggaggaaaacatggttaaaagccaggtgaccgcgggtcagggcacttccgagaccttttcgatgggactgctatgcctcaccctgttcgtggaggagtgcctgcgccggcgcgtcacgcggaagcacatgatcttggcggtggtcatcacgctgtgcgcaataatcttaggcgggctaacatggatggaccttctgagagccctcatcatcctgggcgatacgatgtccggccgaatagggggtcagactcacctcgccatcatggccgtgttcaagatgagccctgggtacgtgctaggagtgttcctgcgtaagctgacctcccgtgaaactgctctaatggtcataggaatggctatgacgaccaccttgtccatcccgcacgacttgatggaactcatcgacggcatctccctgggcctgatcctcctgaagattgtaacacagtttgacaacacgcaagtggggaccctggcgctgtctctgaccttcatacgcagcaccatgagcctagtgatggcctggcggacgatcatggccgtgcttttcgtggtaactctgatccccctgtgccgcacctcctgcctccagaagcagagccactgggtggagatcacagcgctgatcctgggcgcccaggcattacccgtgtatctgatgacgctgatgaagggggcctcccggcgcagctggcccctcaacgagggcatcatggcggttgggctggtctccctgctcggtagcgccctactgaaaaacgacgtgccgctcgccggccccatggtcgccgggggcttgctgctcgccgcgtacgtgatgtccggcagctcggccgacctgtctcttgagaaagccgcaaacgtgcagtgggacgagatggcagacataaccggcagctcccccataatcgaggtgaagcaggacgaggacggctcgttctccatccgggacgtagaggagactaatatgataaccctcctggtgaaacttgcgctcatcactgtcagcggcctgtatcctctggcgatacctataaccatgactctctggtacatgtggcaagtgaagactcagcgatccggcgcactgtgggacgtgcctagcccagccgctacccagaaggctgcactgtccgagggggtctaccggatcatgcagcgcggcctcttcgggaagacacaagtgggcgtggggatccatatggaaggcgtatttcatactatgtggcacgtcacccggggcagcgtgatctgccacgagaccggacgcctggagccctcctgggccgatgtccgcaacgacatgatcagctacggagggggttggcgacttggcgacaagtgggataaggaggaggatgtgcaggtccttgccatcgagccggggaagaatcccaagcacgtccagacgaagcccggcctgtttaagaccctgaccggagaaatcggcgccgtgaccctcgactttaagcccggaacctctggctctcccatcattaaccgcaagggcaaggtgatcgggctgtacggcaacggagtcgtgaccaagtccggcgactacgtgagcgccatcacccaggctgagcggatcggggagcccgactacgaggtcgacgaagacatattcaggaaaaagcggctgaccatcatggacctccatcccggcgcaggtaaaacgaagcgcatcctgccgagcatcgtgcgggaggctctgaaacgccggcttcgcaccctcatcctcgcgcctacccgggtggtagccgctgagatggaggaggcattacgggggctccccatccggtaccagacccccgctgtaaagagcgagcacacgggcagagagatcgtggacctgatgtgccatgcgaccttcaccactcggctgctctccagcacgcgcgttccgaattataacctgatcgtgatggacgaggcccactttactgaccccagctccgtggcagccagaggatatatcagcactcgcgtcgaaatgggtgaggctgctgccatcttcatgaccgccacaccacccggggcaactgacccattcccccagtccaacagccccatagaggacatagagcgggagatccccgagcgctcctggaacaccggcttcgattggataactgactaccagggaaagaccgtgtggtttgtcccgagcatcaaggccggtaatgacattgcgaactgcctgcgcaagtccggcaagaaggtgatccaactctctcggaagaccttcgataccgagtatcccaagaccaaactgacggactgggacttcgtggtcaccactgacatctccgaaatgggggccaacttccgtgccggccgggtgatcgacccccggaggtgccttaagcccgtgatcctgaccgacgggccggaacgcgtcatcctggccggccccatccctgtaacgccagcgagcgccgcccagaggcgcggccggatcgggcgcaacccggcccaggaagacgaccagtacgtgttttccggcgaccccctgaagaacgacgaggaccacgctcactggaccgaggcgaagatgctcctggacaatatctacaccccagaaggaatcattcccaccttattcggccccgagcgtgagaagacgcaagctatcgacggtgagttccgcctccggggcgagcagaggaagaccttcgtcgagttaatgcggaggggcgacctgccggtatggctgagctacaaagtagcctccgccgggatcagctacaaagatcgggagtggtgcttcacaggcgaacgcaacaaccaaatccttgaggagaacatggaggtcgagatctggacccgggaaggggagaagaagaagctgcgccccaagtggctcgacgctcgggtgtacgcggacccaatggctcttaaggacttcaaggagttcgccagcggcagaaagagcatcacacttgacatcctcacggagatcgccagtctgccgacctacctgagctcccgcgccaagctcgcgttagataatattgtgatgctacacaccaccgagaggggcgggcgggcctaccaacatgccctcaacgagctgcccgagagcctggaaacgctcatgctggtcgccctgctcggcgcgatgaccgcaggtatcttcctgttcttcatgcagggcaaggggatcggcaagttaagcatgggcctcatcactatcgccgtggcctccgggctactgtgggtggctgagattcagccccagtggatcgcggccagcatcatcctcgagttctttctgatggttctgctaatccccgagccagagaagcagcggactccacaggacaaccagctgatctacgtgatcctaacgatcctcacgataatcggcctgatcgccgcaaacgagatggggctgatcgagaagaccaagaccgacttcggcttttaccaagtgaagacagaaaccaccatcttggacgtcgaccttcgccccgcctccgcgtggaccctgtacgccgtcgccacgacgatcctcacgccgatgctgaggcataccatcgagaatacgagcgccaacctgtccctcgccgcgatcgccaaccaggccgccgtgctgatgggcctgggcaagggctggcccctccaccgcatggacctgggtgtccccctgctcgccatggggtgttattcacaggtgaaccccaccaccctgaccgcgtccctggttatgctcctggtccactacgccatcatcgggccgggcctgcaggccaaagccacgcgggaggcgcagaaacgcaccgctgcgggtatcatgaaaaacccgaccgtggacgggatcaccgtgatcgaccttgagcccatcagctacgatcccaagttcgagaagcagctgggccaagtcatgctgctagtgctgtgcgccgggcagctgctcttgatgcggacgacctgggccttctgcgaggtgctgaccctcgcgactggaccgatcctgacgctgtgggagggtaaccccggtcgcttctggaacaccaccatcgccgtctccaccgctaacatcttccggggcagctaccttgccggggcaggacttgcattcagtttaattaagaacgcccaaacgcccaggcgtggaacgggtaccgctggggagaccctcggcgagaagtggaagcgccagctgaacagcctagaccggaaagagttcgaggaatacaaacgttccggtatcctcgaggtggaccggacagaggccaaaagcgccctgaaggacgggtccaagatcaagcacgcggtgagccgcggctcctccaaaatccgttggatagtcgagcgcgggatggtgaagcccaagggaaaggtagtcgacctgggctgcggccgcggcggctggtcctattatatggcaacgctcaaaaacgtaacggaggtgaagggctacactaaagggggtccggggcacgaggagcccattcccatggccacttacggctggaacctggtcaaactgcacagcggagtggatgtgttttacaaacccacggagcaggtcgatacgctcctttgcgacatcggggagtcgtcaagcaacccgaccattgaggagggccggaccatgcgcgtgttgaaaatggtagaaccctggctctcctcgaagcccgagttttgcattaaagtcttaaacccctatatgccaacggtgatcgaggaactggagaagctgcagcgaaagcacggtggcaacctcgtgcgctgccctttgtcacggaacagcacccacgagatgtattgggtttccggagccagcggaaacatcgtgtccagcgtcaacaccacatccaagatgctattgaaccggttcacgacccggcaccgcaagcccacctacgagaaggacgtcgatctgggagcagggacccgaagcgtgagcacggaaaccgagaagcccgacatgaccattataggccgccggcttcaacgcctccaagaggaacataaggaaacctggcactacgatcaggagaacccgtaccggacgtgggcctaccatgggagctacgaggccccctccacaggcagcgcctcgagcatggtcaatggcgtggtgaaacttctgacaaaaccctgggatgttatcccgatggtgacccagctcgccatgacagacaccacccccttcgggcagcagcgcgttttcaaggagaaagtcgacactcggacaccccagcccaagccaggtacacgcatggtgatgacgacgacggcgaactggctgtgggccctattagggaagaagaagaacccccggctgtgcacccgcgaagagttcatcagcaaggtccggagcaacgctgccatcggggccgtcttccaagaggagcagggctggacatccgcatccgaggccgtgaacgactcgcgcttctgggagctggtggacaaggagcgggccctccaccaggaggggaagtgcgagtcctgcgtctacaacatgatggggaagcgcgagaagaaacttggggagttcggccgcgcaaaagggagcagagccatttggtacatgtggctgggcgcgcgcttcctcgagttcgaagcccttggattcctgaacgaggaccactggttcggtcgcgagaactcctggagcggcgtggagggtgagggcctccaccgcctggggtacatcctggaggagatagacaagaaagacggcgacctgatgtacgctgacgatacggccggctgggacacgcggatcaccgaggacgacctccaaaacgaggaactaatcaccgagcagatggcgccacatcacaagatactcgcgaaggccatctttaaactgacctaccagaacaaagtggtcaaggtgctgcgccctaccccgcggggagcggtgatggacatcatctcgcgcaaggaccagcggggtagcgggcaggtcggtacttacgggttgaacaccttcaccaacatggaagtacagctaatccgccagatggaggccgaaggcgtgatcactcaggacgatatgcagaatcccaagggcctgaaagaacgtgtcgagaagtggctcagggagtgcggggtggacagattaaagcgcatggcgatctcaggcgacgactgcgtggtcaaacccctagacgagcggttcgggacgtctctcctcttcctgaacgacatgggcaaggttcgcaaggacattccccagtgggagccttccaaggggtggaagaactggcaggaggtgccgttctgctctcatcacttccacaaaatctttatgaaggacggcaggtccttagtggtgccatgccgcaaccaggacgagttgatcggccgggcccgcattagtcagggggccggctggtcccttcgtgaaaccgcctgtctcggcaaggcttacgcccaaatgtggtcgctgatgtacttccacagacgcgatctcaggctcgcctccatggccatctgcagcgccgtgcccaccgagtggttccctaccagccgcacgacctggtccatacacgcccaccaccagtggatgactaccgaggacatgctgaaagtctggaaccgggtgtggatcgaggacaatccaaacatgatagacaagactcctgtgcacagctgggaagacatcccctatctgggcaaacgcgaggatctctggtgcgggtccctgatcggcctgagctcccgagcgacttgggccaagaacattcataccgcgatcacgcaggtccgaaacctgatcggcaaggaagagtacgtggattatatgccggttatgaagcggtactccgctccctccgagagcgagggggtgctttga

SEQ ID NO: 26323 - RNA, 9867 nt, synthetic construct
  misc_feature 1..9867: note = derived and/or modified CDS sequence (opt11) from DENV-4__KJ596672__SS-prME
  source 1..9867: mol_type = other RNA
tccacgataacactgctttgcctcattcccaccgtaatggcgttccatctcagcacccgggacggtgaacctttaatgatcgtcgccaaacacgaaagaggccgcccactcctgttcaaaacaacagaagggatcaacaaatgcacgctcatagctatggacttaggagaaatgtgcgaagacacagtcacatacaaatgcccgttattggttaacacggaaccagaggacatcgactgctggtgcaacctaacctcaacgtgggtcatgtacggaacatgtacgcagagcggagaacgacgtcgggagaaaaggtcagtggccctgaccccgcactccggcatgggactagaaaccagagcggaaacttggatgtcaagcgaaggagcatggaaacatgcacaacgcgtagagtcttggatactacggaaccccggattcgctctattggcaggcttcatggcatacatgatcgggcaaaccgggatacaaaggacagtcttcttcgttctaatgatgctggttgccccaagctacggcatgcgctgcgtgggagtcggaaaccgggacttcgtggaaggggtctcaggcggggcatgggtggatttggtcctcgagcacggtgggtgcgttacaaccatggcccagggaaaacccaccctggacttcgagctcactaaaacaaccgccaaagaagtagcattgctaaggacctattgcatcgaagctctgatatctaatattacaacagctacaaggtgtccaacacaaggcgaaccataccttaaagaagaacaagaccagcaatatatctgccgccgagacgtagtggacagagggtggggaaacggctgcggcctgtttgggaaaggcggggtagtcacttgcgccaaattttcctgctcgggcaaaataaccggaaatctcgttcaaatcgaaaacctggagtacactgttgtggttactgtccataatggagacactcacgcagtcggcaacgacacatccaatcatggggtcaccgcgactataacaccacgctcgccatcagtcgaggtaaaactacctgactatggggaactaaccctcgactgcgaaccaaggagtggaatagacttcaacgaaatgatcttaatgaaaatgaagaagaaaacctggctggtccataaacaatggttcctcgacctgccactcccttggaccaccggcgcagacacaagcgaggtacattggaactacaaagagcggatggtcaccttcaaagtcccgcacgctaaacggcaagacgtcacagtcctaggctcccaagaaggcgcaatgcactcagcacttgccggtgccacagaggtcgacagcggcgacggcaaccacatgtttgcaggacatttaaaatgcaaagtcaggatggagaaattacgtatcaaaggcatgtcatacactatgtgctcagggaaattcagcattgacaaagagatggccgagacccagcacgggacgactgtagtcaaagtaaaatacgagggcgcaggggctccctgcaaagtcccaattgagatccgcgatgtcaacaaggaaaaagtagtgggccgagtaatctcagcgactccactcgcagaaaacacgaactcggtcacaaacatagaactagaaccaccattcggcgactcgtacattgtgatcggggtgggcaactccgcactaacccttcactggttccgcaagggaagctcgataggaaagatgtttgaatcaacttatcggggcgcaaagaggatggccatcttaggcgagacggcctgggacttcggttccgtaggagggctattcacttcactgggaaaagctgtgcaccaggtcttcggatcagtctacactaccatgttcggaggtgtgtcctggatgatccggatcctaatcggatttctggtgctatggatcgggaccaacagcaggaacaccagcatggccatgacgtgtatagcagttggcggtattaccttattcctagggtttactgtacaagccgacatggggtgcgtcgtctcctggtccggacgagagctaaagtgtgggtcggggatcttcgtggtagataatgtgcacacatggacagagcagtataagttccaacccgagtccccggcccggctggcatccgccatactaaatgcccacaaagacggcgtgtgcgggatcagaagcaccaccagacttgaaaatgtcatgtggaagcagataaccaacgaactgaattacgtcctctgggagggaggacacgacctcactgtggtagcgggagatgtaaaaggagtgctcactaagggcaaaagagcccttacgccacccgcgtccgatctcaaatattcatggaagacatgggggaaagcgaagatctttactcccgaagcccgcaacagcacgttcctgatcgacggcccggacacaagcgagtgcccaaatgaacgccgcgcgtggaactcatttgaagtagaagactacgggttcgggatgttcaccaccaatatctggatgaaattcagagaaggcagctccgaggtctgcgaccacaggttaatgagtgcagccataaaggaccaaaaggcggtacatgcagatatgggttactggatagaaagcagtaagaaccaaacatggcagatagaaagggcgagcctcattgaggtaaaaacctgcctctggcctaaaacgcatactctgtggagcaacggagtactcgaatcgcaaatgctgatccccaagagctatgcaggccctttcagccagcataactaccgccagggctacgccacgcaaacagtagggccatggcacctagggaaactggaaatagactttggagaatgccccggtacgaccgtaacaattcaagagaactgtgaccacagaggtccctcattaaggactacaactgcctcgggcaagctcgtaacacaatggtgttgtcgtagctgtacgatgccgccactcaggtttttgggggaagatggctgctggtacgggatggagatacgaccactcagcgaaaaggaggaaaacatggtaaaatcgcaggtaaccgccggccaaggtacctcagaaacattctcgatggggctcctatgtctcacactatttgtcgaggagtgtctcagaagacgagtcacaagaaagcacatgatcctcgccgtggtaattacactatgcgctatcatactgggagggctaacatggatggacctcctgcgcgccctcataatgttaggagacacgatgtcgggccgaataggagggcaaacacatctcgcaataatagcagtttttaaaatgagcccgggatatgtgctaggagtcttcctacgtaaactcacatcacgcgaaacagccttgatggtaatcgggatggccatgacgacaaccctctccatcccccacgacctaatggagctaatcgacgggatatccctgggattaatcctgctaaaaatagtaacccaatttgataacacacaagtgggcacgctcgcgctctcactcacattcatccgttccacaatgtcgcttgtcatggcctggcgcactataatggcagtactcttcgtggtcaccctcattccgctctgtcgaacgtcatgtctccagaagcaaagccactgggtggaaataacggcgttgatcctaggagcccaggcacttccggtctatctcatgacactgatgaagggagcctcacgaagaagctggccactaaacgaaggaataatggccgtcggtttagtcagcctactcggctcagcgctactcaaaaatgacgtccccctggccggtcccatggtcgccggcgggttactcctagcagcgtacgtcatgagcgggtcatccgccgacctgtccctcgagaaagcggcgaacgttcaatgggacgagatggctgacatcaccggatcaagcccgatcattgaggtgaagcaggacgaggatgggtcattctcaatacgcgacgtagaggaaacgaacatgatcacactgctggtcaaactagccttaatcactgtgagtggcctctatccactcgccataccgataaccatgacactctggtatatgtggcaagtcaagacgcagcggagcggcgccctatgggatgtacccagtcccgcggcaacgcagaaagctgccctaagcgagggagtatacagaataatgcaacgtggacttttcggaaagacgcaagtaggagtaggaatacacatggaaggcgtgttccacaccatgtggcacgtcacaagagggtcagtgatatgtcacgaaactggtcgactggaaccgtcttgggccgatgtgagaaatgacatgataagttatggaggagggtggcgccttggggacaaatgggacaaggaagaggacgtacaagttttagcaatagaaccggggaaaaacccgaagcatgtgcagaccaagccgggactcttcaaaacgctaaccggggaaatcggggccgtgacccttgatttcaagcccgggaccagtggttcgcccattatcaatcggaaggggaaggtcattgggctctatggaaacggagtagtaacgaagtctggcgactacgtctccgcaataacccaagcagagcgcataggggaaccggactacgaggtagacgaggacatcttccgtaagaaacggctgaccataatggatctacaccccggagcaggaaaaacaaaacggatactgccctccattgtccgagaagccttaaaacgccgcctccgcaccctaatactcgcgcccacgcgagtggtcgctgcagagatggaggaagcactacggggactgccgataaggtatcagacgccagcagtaaagtcagagcacaccggccgcgaaatcgtggaccttatgtgtcacgcgacctttacaacccgcttactgtcaagcacaagagtcccaaactacaacctgatcgtcatggatgaagcgcacttcacggacccctccagcatcgcggcccgaggatacatatcaaccagagtggaaatgggagaagcggcggcaatctttatgacagctacaccacctggtgccacagacccattcccgcagtctaacagtcccatagaagacatcgaacgcgagattcccgaacggagttggaacaccggatttgactggatcacagactaccaaggaaaaacggtctggttcgtgccgagcataaaagctgggaacgacatagcgaactgcctccggaaatcaggcaagaaagtcatccaactaagcaggaagacattcgacacggaataccctaaaaccaagctcacggactgggacttcgtcgtaaccacggatattagcgagatgggcgctaacttcagagcaggccgtgtaatcgacccccgccggtgcctaaagcccgtgattctcaccgatgggccagaacgcgtgatcctagcagggcccatacctgtgacgccggcgagcgcggcacaaaggcggggtaggatcggcaggaacccggcccaagaagacgaccagtacgttttctcaggcgacccccttaagaacgacgaggaccacgcccattggaccgaagcgaaaatgctcctagacaatatatacacacccgaggggataataccgaccctatttggaccggagagagaaaagacgcaggctatcgatggcgagttccgactccgcggagaacaaaggaagaccttcgttgagctaatgagacgtggagacctccccgtgtggctgtcatacaaagtcgccagcgccggaatcagctacaaagacagggaatggtgtttcaccggtgagagaaataaccaaatcctagaggaaaatatggaagtggagatttggacacgggaaggggagaagaagaaacttcgaccgaagtggctagacgcgcgcgtgtacgctgacccaatggcactgaaggacttcaaagagttcgcgagcggccgcaaatcaattacactagacattttgacggaaatagcgtcactgcccacgtacctaagctccagagcaaagttggctctggacaacatcgtaatgcttcacacgacagaaaggggcgggcgagcttaccaacatgccctaaacgaactacccgaatccttagaaaccctcatgttagtggcactgttaggcgccatgaccgcggggatcttcctgtttttcatgcaggggaaaggaataggaaagttatccatgggccttataaccatcgcagtggccagtggtctactctgggtcgcggaaatacagcctcaatggatcgcagcctcgataatattggagttctttcttatggtactcctcatcccggagccggaaaaacaaagaacaccccaagacaaccaactcatctacgtcatcttgactatccttacgatcattgggctaatcgcagccaacgaaatggggctgatcgagaaaacaaagacagacttcggcttctatcaagttaaaacagaaacaacgatcctcgatgtcgacctacgacctgcatccgcgtggacattatacgccgtggccactacgatactgacccccatgctaagacacacgattgagaacacatccgcaaacttatccctagccgctatcgcaaaccaagccgcggtcctaatggggctaggcaaagggtggccgttgcacaggatggaccttggtgtcccactactagctatgggctgctacagtcaagtaaacccgacaacgctgactgcgagcctggtaatgctcttagtacactacgccataatcggacccgggttgcaagcgaaagcaacccgcgaagcccaaaagagaacagccgcaggaataatgaagaaccccacggtggatggaataaccgtaatagacctagaaccaatatcatacgatccaaaattcgagaagcagttaggacaggtgatgttactggtcttgtgcgccggccagctgttactaatgaggacgacgtgggccttttgcgaagtgctgacactagcaaccgggcccatattgacgctgtgggaaggaaatcccgggcggttctggaacaccacgatagcagtatccactgcaaacatattccgaggtagctacctagccggcgcgggactcgctttcagtctcatcaaaaacgcgcaaacaccaagacgtggtaccggaacagccggggagacactaggcgaaaaatggaagcggcagctaaattccctggatagaaaggaatttgaagagtacaaacgatctggcatattagaagtcgaccgaactgaggcaaagtcggcgctgaaagacggctcaaagatcaaacacgccgtcagcagaggttcgtcaaaaatccgatggatagtcgaaaggggaatggtaaaaccgaaagggaaagtagtagatctgggttgcggcagaggcggatggtcatactacatggctacgctcaaaaatgtcaccgaagtaaaaggatatacgaaaggaggaccaggccacgaggaacccatcccgatggctacttacggctggaatctggtaaaattacatagcggcgtagacgtcttctataagcctaccgagcaggttgacacccttttatgcgatatcggtgagtcgagcagcaacccgacgatagaagaaggacgtaccctccgcgtgctgaaaatggtcgagccatggctctccagcaagcccgaattttgtatcaaggtcctgaacccgtacatgccaacagtcatagaagaactcgagaagctccagcgcaagcacggaggaaatctggtccggtgccccctgtcccgcaattctacacacgagatgtattgggtaagcggagcttctggcaacatagtctcgtccgtaaacacaaccagcaagatgcttctaaaccgcttcacgacacgccatagaaaaccgacatacgaaaaggacgtagacttgggagcaggaaccagatccgtcagcacagaaatagaaaaacccgacatgacaataataggacgacgcttgcaacgactacaggaggaacacaaagaaacatggcattacgaccaagaaaacccctacagaacctgggcttaccatggctcttatgaggcgccatcaacgggatcagcatcctctatggtgaatggagtggtcaaactactcacaaagccatgggacgttataccgatggttacgcagttagcgatgacagacaccacgccgttcggacagcagcgtgtgttcaaagaaaaagtcgatacccgaacgccccaacccaaacccggcacaagaatggtgatgaccaccacggcgaactggctgtgggcccttctggggaaaaagaaaaatccccgcctatgcacccgcgaagagttcatcagcaaggttcgtagcaacgctgcgatcggagctgtgttccaggaagaacagggctggacaagtgcgtccgaagcagtgaacgatagtcgtttctgggagctggtagacaaagaaagagcgcttcatcaggagggaaaatgtgaaagctgcgtctataacatgatgggaaaacgggagaagaaactcggggagttcggccgagcgaaaggatcacgtgccatatggtacatgtggctgggggctcgcttcctggagttcgaggcactaggcttcttgaacgaagatcactggtttggaagagagaacagttggtctggcgtcgaaggggaggggctgcaccgcctgggttacatcctggaagaaatcgacaagaaagatggagacctgatgtacgcagacgatacagccggctgggatacacgaataacagaggacgacctgcaaaacgaggaactaattactgagcaaatggcaccgcaccacaaaatactagcgaaggctattttcaagttgacgtaccagaacaaagtcgtaaaagtgctacgaccgaccccgcggggcgcggtcatggacatcataagccggaaagaccagcgcggcagcgggcaagttggaacatacgggttaaatacattcacaaatatggaggtccaacttatcaggcaaatggaagcagagggagtaattacacaagacgatatgcaaaacccaaagggcttaaaggagcgagtagaaaaatggcttcgggaatgcggagtcgataggctaaagcgcatggcaataagcggagacgactgtgtagtgaagcccttggatgagcgattcggaacatcactactcttcctgaacgatatgggaaaagtccgaaaggacataccacagtgggaaccgtcgaaaggatggaaaaactggcaagaggtacccttctgctcacatcacttccacaaaatattcatgaaagacgggaggtccctcgtcgtaccgtgtagaaaccaagacgaattaataggaagggcaagaataagccagggcgcggggtggtccttaagagaaacggcgtgtctcggcaaggcatacgctcaaatgtggtcactgatgtatttccaccggagagatctgcgactagcatcaatggcaatatgttccgctgtcccaacggaatggttccccacaagtcgaacaacgtggagtatccacgcacatcaccaatggatgacaacagaggacatgctgaaagtctggaacagggtctggatagaagataacccgaacatgatagacaaaacgccggtccactcatgggaggatataccatatctaggcaaacgagaggacctatggtgcggatctttgatcggcttatccagtagagctacatgggctaaaaacatacatacagccataacccaggttcgcaatctgattgggaaagaggaatacgtggactatatgtcggttatgaagagatactccgcaccatcagaatccgagggcgtcctctaa

SEQ ID NO: 26324 - RNA, 9867 nt, synthetic construct
  misc_feature 1..9867: note = derived and/or modified CDS sequence (opt11) from DENV-4__KJ579242__SS-prME
  source 1..9867: mol_type = other RNA
agcactatcacgctgctgtgcctgatcccaacggtcatggccttccatctgtccacccgcgacggcgagccgcttatgatcgtcgccaaacacgagcggggacgccccctgctattcaagacaaccgagggcattaacaagtgcacgctcatcgcgatggacctgggggagatgtgcgaggacacagtgacatacaagtgccccctcctggtgaacaccgagcccgaggacatagactgctggtgtaatctgactagcacgtgggtcatgtacggcacctgcacccagtccggggagaggcgacgggaaaagcgaagcgtggccctcacgccgcactccggtatgggcctcgagacacgagccgaaacttggatgagctcggagggggcgtggaagcacgcccaacgcgtggaaagctggatcctgagaaacccgggattcgcgctgttggcagggttcatggcttacatgataggccagacagggatccagcgcaccgtcttctttgtgctgatgatgctggtggccccatcctacggcatgcggtgcgtcggcgtggggaaccgcgactttgtggagggcgtttcggggggcgcgtgggtggacctcgtgctggagcatggggggtgcgtcactaccatggcacagggaaagccgaccttagacttcgaactcacgaagaccaccgcaaaggaggtggctcttctgcggacctactgcatcgaggccctcatttcaaacatcactaccgcgacacgttgcccgacccagggggagccctacctgaaggaggagcaggatcaacagtatatatgccggcgagacgtggtcgaccggggctggggtaacggatgcggcctgttcgggaagggcggtgtcgtaacgtgcgccaaattctcatgctccggtaagatcactgggaacctcgtccagattgagaacctggagtacaccgtggttgtcaccgtgcacaatggagacacgcacgccgttggtaacgacaccagcaaccacggtgtgacagccactatcactccccgctcccccagcgtagaggtgaagctgccggactacggcgagctcacactggactgcgagccccggtctgggatcgacttcaacgaaatgatcttgatgaaaatgaagaaaaagacctggttagtgcacaagcagtggtttttagacttacccctgccctggaccaccggtgccgacacgagtgaggtgcactggaactataaggagcgcatggtcacatttaaggttccccatgcgaagcggcaagacgtgaccgtgctggggtcccaggaaggcgccatgcatagcgccctggccggcgccaccgaggtggacagcggggacggcaaccacatgttcgcgggtcacctcaagtgcaaggtgcgcatggagaaactgagaatcaagggcatgtcctatacgatgtgcagcggcaaattctccatcgacaaggagatggctgagacccagcacggcaccacggtcgtgaaggtgaagtacgaaggcgccggtgccccctgcaaggttcccatcgagatcagagatgtcaacaaggagaaggtggtcggacgcgttatctcagcgactcccctagcagagaacacgaacagcgtcaccaatattgagttggagccgcccttcggtgatagttacatcgtcatcggcgttggaaactccgccttaactctgcactggttccggaaggggagctccatcggcaaaatgttcgagtcaacctacagaggtgccaagcggatggccatcctgggcgaaacagcgtgggatttcgggtccgtgggcggcctgttcaccagcctcgggaaggccgtccaccaggtgttcggctccgtgtacaccacgatgttcgggggcgtaagctggatgatccgcattctcatcgggttcctggtactttggattggcaccaattcccggaacacaagcatggcaatgacctgcatcgctgtaggcgggatcacgctgtttctcggcttcaccgtccaagccgacatggggtgcgtggtgtcctggtcgggccgggagttgaagtgcgggtccggcatcttcgtcgtggacaacgtccacacctggactgaacaatacaagttccagcccgagagccccgcgcggctggccagcgcgatattaaacgcccacaaagacggcgtctgtgggatcaggtcaaccacccggctggagaacgtgatgtggaagcagatcacaaacgagctgaactacgtactctgggagggcgggcatgacctgaccgtcgtggcgggcgacgtgaagggcgtcctcaccaagggcaagcgagcgctcaccccgcctgccagcgatctaaagtactcctggaagacctggggcaaggcaaagatcttcacccccgaggcccggaactcgactttcctgatcgacgggccagacacctcggagtgtcctaacgagcgccgggcctggaacagcttcgaggtggaggactacggcttcgggatgttcaccacaaacatatggatgaagttccgcgaggggtcaagcgaggtctgcgaccaccggctcatgagcgcggccatcaaggaccagaaggccgtccacgccgacatgggctattggattgagagctctaagaaccagacgtggcaaattgagcgcgcgtcactgatagaggtgaagacctgtctgtggccaaaaacccacaccttgtggagtaatggggtgctggagtcacaaatgctgatccccaagtcctacgcggggccgttctcccagcacaactacagacaggggtatgccacccagacggtcggcccctggcatctcgggaagctggagatcgactttggcgagtgccccggcaccaccgtgacgatccaggaaaactgcgatcaccgcgggccctccctccgcacgaccaccgcctcggggaaactcgtgacacaatggtgttgccggtcctgcacgatgccaccactgagattcctcggggaagatgggtgctggtacgggatggaaatccggcccctctccgagaaagaggagaatatggtcaagagccaggttaccgccggccagggcaccagtgagaccttcagcatgggcttgctgtgcctcacgcttttcgtcgaagagtgcctgcgccggcgcgtgacgcggaagcacatgattctggcggtggtcattaccctgtgcgccataattctggggggcctcacctggatggacctgctgcgcgcgctcataatcctcggcgacacgatgagtggccggatcggcggccagacccacctggccatcatggccgtgtttaagatgtcccctgggtacgtacttggggtttttctcaggaagctgacgtctcgagagaccgcgctaatggtaattgggatggccatgacgaccactctaagcatcccgcacgacctgatggagctcattgacggcatctcccttggcttaattctactgaaaatcgtgacacaatttgacaacacgcaggtcggtaccctcgccctcagcctgacattcatccgcagtaccatgagcctggtgatggcctggcggacgataatggcagtgctcttcgtcgtgaccctgatccccctgtgccgcaccagctgcctccagaagcagtctcattgggtagagatcaccgcactgatcctgggcgcccaggccctccccgtgtacctaatgacgctgatgaagggagcctccaggcgctcgtggcccttaaatgaaggcatcatggcggtcgggctggtttccctgctcggtagcgccctgctcaagaacgacgtcccgctcgcaggccccatggtggctgggggactcttgctcgccgcgtacgttatgtccggcagcagcgccgacctgagtctggagaaggcggccaacgtccagtgggatgagatggccgacatcaccggctcctcccccatcattgaagtgaagcaggacgaggacgggagcttctctattcgtgacgtagaagagaccaacatgatcacccttctggtcaagttagcgctcatcacggtgagcggtctttaccccctggccatcccaatcaccatgaccctgtggtacatgtggcaggtgaagacccagcgctccggagcactgtgggacgtcccttcgcccgccgccacacagaaggcagccctctccgaaggggtgtaccgaatcatgcagcgcggcctcttcgggaagacgcaggtgggcgtcgggattcacatggagggagtgttccacaccatgtggcacgtgactcggggcagcgtcatctgtcacgagaccgggcgcctggagccctcctgggcggacgtgcgcaacgacatgatctcctatggtggaggctggcggctcggcgacaagtgggataaggaggaggatgtgcaagtcctcgccattgagccggggaaaaaccccaaacacgttcagaccaagcccggcctgttcaagacccttaccggtgagatcggcgccgtcaccctcgacttcaagcccggcacgtctggcagcccgatcattaatcgcaagggcaaagtcatcgggctctacgggaatggggtggtaactaagagtggcgactacgtcagtgccatcacccaggcggagcggatcggggagcccgactacgaagtggatgaggatatcttccggaagaagcggttaaccataatggacctccaccccggcgcagggaagacgaagcgtatcttaccgtccatcgtccgggaagccctgaagcgccgtctgcgcactctcatcttagcccccacccgggtggtggccgccgagatggaggaagccctacgcgggctccccatacggtaccaaactcccgcggtgaagagcgagcacacgggccgcgaaatcgtcgacctgatgtgccacgcgaccttcaccacccggctgctctccagtacccgcgtgccgaactacaacctgatcgttatggacgaggcgcacttcactgacccctcctccgtggccgccaggggctacatcagcaccagagtagaaatgggcgaggcggcagcaatcttcatgactgccacgccccccggggccaccgacccgttcccccagtcaaacagccccatcgaagacatagagcgtgagatccccgagaggtcctggaacaccggcttcgactggatcacggactaccagggtaaaacggtctggtttgtgcccagcatcaaggcagggaacgacatcgcgaactgcttgcgaaagtccggcaagaaagtcatccagctcagccggaagacgttcgacaccgagtaccctaagactaagctcacggactgggacttcgtggtgacaacggacatatccgagatgggggccaactttcgcgccgggcgggtaatcgacccacgccgatgcctgaagcctgttatcctcactgacgggccggagcgagtgatcttagccggccccatacccgtcacgcccgcgagcgccgcacaacggcgcggccggatcgggagaaacccagcccaggaggatgaccagtacgtattctccggcgatccgctgaaaaacgacgaggaccacgcgcactggaccgaggcgaagatgctcctggataatatctatacgcccgaggggattattcccaccctgttcggcccggagcgggagaaaacgcaggccatcgacggcgagttcagattacggggggaacagcggaagacgttcgtggagctaatgaggcggggcgacctgcccgtatggttgtcatacaaggttgcctctgccgggatcagctataaggatcgggagtggtgcttcaccggcgagcggaacaaccaaatcctggaagagaacatggaggtggagatctggacccgggagggtgagaagaagaagctgcgccccaagtggctcgatgcccgggtatatgcggaccccatggcccttaaggacttcaaagagttcgcctccggtcgcaaaagcatcaccctggacatcctcacggaaatcgcctctttaccgacttacttgagctcccgcgctaagctcgcgctggacaacatcgtaatgctgcacactaccgagcggggcgggcgcgcctaccagcacgccttgaacgagctgccagaaagcctggaaacactcatgctagtcgccctgctgggagcgatgaccgccggaatcttcctgttcttcatgcaggggaagggaataggcaaactgagcatgggcctgatcaccatcgccgtggcctccgggcttctgtgggtggccgagatccaaccgcagtggatcgccgccagcatcatcctcgagtttttcctgatggtactcctcattcctgagcctgagaagcagcggacaccccaggacaaccagttaatctacgtgatcctgacgatactaacaattatcggcttgatcgccgccaatgaaatgggactcatcgagaagaccaaaaccgacttcggattctaccaggtcaagactgagaccaccatcctcgatgtggatctgcgccccgcctccgcctggacactgtacgccgtggccacgaccatcctcaccccgatgctgcgacataccatcgagaacacgagcgccaacctgtccctcgccgcgatcgcaaaccaggccgccgtcctgatggggctggggaagggttggcccctccatcgcatggacctgggagttcccctgctagccatgggttgctacagccaggtcaaccccactaccctcaccgcgtccctggtcatgctcctggtgcactacgccattatcggacctggcttgcaggcgaaggccacgcgggaggcgcaaaagcgcaccgccgcaggtataatgaagaaccccaccgtggacgggatcaccgtcattgacctcgagcccatcagctatgaccccaagttcgagaagcaattgggccaggtgatgctgctcgtcctgtgcgccggtcagcttctcctgatgaggacgacctgggcgttctgcgaggtgctgaccctcgccaccggcccgatactcacgttatgggaagggaaccccggacgcttctggaacaccacgatcgctgtgtccaccgccaatatcttccgcggctcctatctcgccggggccggcctggtgttcagtctgatcaagaacgcgcagacgccccgtcgggggaccggtaccgccggggagaccctcggcgagaagtggaagcgccagctgaactctctggaccggaaagagttcgaggagtataagcgttccggcattctcgaagtggaccggaccgaggcgaagtcggccctcaaggacgggtccaagatcaaacacgccgtaagccggggctcctctaagattcggtggatcgtcgagcgagggatggtcaaacccaagggcaaagtggtggatctggggtgcggccgcggagggtggtcctactacatggcgacgctcaagaacgtgaccgaggtgaagggctacaccaaggggggtccgggccacgaggagcccattccaatggcaacctacggctggaacctagtcaagctccacagcggtgtcgacgtcttctacaagcctacggagcaggtggacaccctcctgtgcgacatcggggagagctcctcgaacccgacgatcgaggagggccggaccatgcgcgtcctgaagatggtggagccatggcttagttcgaagcccgagttttgtatcaaggtgctgaacccctacatgccaacggtaatcgaggagctagagaaactgcaaaggaagcacgggggcaacctcgtacgctgtcccctgtcccggaacagcacccacgagatgtactgggtctctggcgccagcgggaacatcgtgtcgagtgtaaacaccacatcaaagatgctgttgaaccggttcacgacacggcaccgaaagcccacatacgagaaagacgtcgacctgggcgctggcacccggtctgtttccactgaaaccgagaagcctgatatgaccatcatcggccggcggctgcagcgcctccaagaggagcacaaggagacctggcactacgaccaggagaacccgtaccggacgtgggcgtaccacgggagctacgaagccccttctaccggcagcgcctccagtatggtgaacggcgtcgtgaagctgttaactaagccctgggacgtgatcccgatggtcacacagttagcgatgactgacaccacccccttcgggcagcagcgcgtgttcaaagagaaggttgacacgcgtacgccccagccaaaaccgggaacccgcatggtcatgaccaccacagcaaactggctgtgggcgctactcgggaagaagaagaatccccgcttatgcacacgggaggagttcatctccaaggtgcggagcaacgccgctatcggggcggtgtttcaggaagagcaagggtggactagcgcctccgaagcggtaaacgacagccgcttctgggagctggtggacaaagagcgggccctccaccaggagggcaagtgcgagtcttgcgtgtacaacatgatgggcaagagagagaaaaaactaggggagtttggcagagccaaggggagccgggccatctggtatatgtggctgggcgcccgcttcctcgagttcgaggcgctgggttttttgaacgaggaccattggttcggccgggaaaactcctggagcggtgtcgagggcgaaggcctacacagattggggtacatcctggaggagattgacaagaaggacggcgacctcatgtatgcggacgataccgcaggttgggacactcggatcactgaggacgacctacagaacgaggagctgatcaccgagcagatggcccctcaccacaagatcttagcgaaggccatcttcaaactaacctaccagaacaaggtggttaaggtcctgcgccccaccccgcggggggccgtgatggacatcatctctcgcaaggaccaaaggggcagcgggcaggtgggcacgtacgggctcaacacctttaccaacatggaggtgcagctgatcagacagatggaggcagagggcgtgatcacccaggacgacatgcagaatccaaagggcctgaaggagcgggtggagaaatggctccgcgagtgtggggtcgatcgactgaaacgtatggcgatttccggcgacgattgtgtggtgaagccccttgacgagcgtttcgggacgtcattgctgtttctgaacgacatgggaaaggtccggaaggacataccccagtgggagccgtccaagggttggaagaactggcaggaggtgcctttctgcagccatcactttcataagatcttcatgaaagatggccggagtctcgtagtgccatgccgcaaccaggacgagctaatcggccgagcacgcatcagtcaaggggccggttggtcgctgagggagaccgcttgccttgggaaggcctacgctcagatgtggagcctgatgtacttccaccggcgtgacctccgtctcgcttctatggccatctgctcggccgtacccactgagtggttcccgaccagccgcacgacctggtccatccacgcccaccaccagtggatgaccaccgaggacatgctgaaagtgtggaaccgggtatggatcgaggacaatccgaacatgatcgacaagacgcctgtgcattcgtgggaagacatcccctacctgggcaagcgcgaagacttatggtgcggatccctgataggcctgagctcccgggcaacctgggccaaaaatatccacaccgcaatcacccaggtgcgaaacctcataggcaaggaggagtacgtcgactatatgccggtgatgaaacggtactccgccccctcggagagcgagggcgtgctgtaa

SEQ ID NO: 26325 - RNA, 9867 nt, synthetic construct
  misc_feature 1..9867: note = derived and/or modified CDS sequence (opt11) from DENV-4__GQ398256__SS-prME
  source 1..9867: mol_type = other RNA
agcaccatgactcttctctgcctgatcccaaccgtgatggccttccatctatcgactcgcgatggcgaaccactcatgatcgttgccaagcacgagcggggtagacccttactcttcaagactaccgaaggaatcaacaagtgcacgctcatagcgatggacctcggggaaatgtgtgaggacaccgtgacctacaagtgccccctgctcgtcaacaccgagcctgaggatattgactgctggtgcaacctgacgtctacttgggtgatgtacgggacctgcacgcagaacggggagagacggcgtgaaaaacgctctgtggccctgacgccacactcgggcatgggcctagaaacccgcgccgagacttggatgtcaagtgagggggcttggaagcacgcgcagcgcgtggaatcgtggatcctgcggaacccgggtttcgcgctgctggccgggtttatggcctatatgataggccagacagggatccaacgcacagtgttcttcgtgctcatgatgctggtcgcgccaagctatggcatgcgctgtgttggagtgggcaatagggacttcgtggagggcgtctccggcggagcttgggtggacctcgtgttagagcacggcgggtgtgtcacgacgatggcccagggcaagcctaccctggatttcgagctcaccaaaaccaccgccaaggaggtggccctcctacggacctactgtatcgaggcgtccatctccaacattaccaccgcgactcgttgcccaacccagggagagccctacttaaaagaagagcaggaccagcagtacatttgtcgccgcgacgtcgtcgaccgtggctggggcaacggctgtggcctctttggaaagggtggggtggtaacgtgtgctaagttcctgtgctcgggtaagataaccgggaatctcgtccagattgagaatctggagtacaccgtggctgtcaccgtccacaatggggacacgcacgctgttggcaacgatacctccagccacggggtcaccgccaccatcacgcccagatccccaagtgtggaggttaagctgccggattacggcgagttaaccctagactgcgagccccggtccggcatcgatttcaacgagatgatactgatgaagatgaaaaagaagacttggctagtgcacaagcaatggtttctggacctgcctctcccgtggacagctggtgcggacaccagcgaagttcactggaaccacaaggaacgcatggtaactttcaaggtcccgcatgcgaagcggcaggacgtgaccgtactcgggtcccaagagggcgctatgcattcagccctggcgggagccaccgaggtcgactcaggggatggcaaccacatgttcgcagggcacctaaagtgcaaagtgcggatggagaagctccgtattaagggcatgtcctacacgatgtgcagcggaaagttctccatagacaaggagatggccgagacgcagcacggcaccacagtggtaaaggtgaagtacgagggcgcaggggcaccctgcaaggttcccattgagatcagagatgtgaacaaggagaaggttgtgggccgaattataagctccacgcccttcgcagagaacactaacagcgtcacgaacatcgagctggagccgcccttcggggactcctacatcgtaatcggcgtcggcgagtcagcgctgaccctgcactggttccggaaggggtcctcaatcggcaagatgttcgagtccacctaccgtggtgccaagcgaatggccatactgggcgagacagcatgggactttggctcggtgggcggcctcttcacctcgctggggaaggcggttcatcaggtattcggcagcgtatacacgaccatgttcggtggtgtatcctggatggtgcgcatcctcataggtttcctcgtcctgtggataggcacgaacagccggaacacaagtatggccatgacctgcatagcagtgggcggaatcacactgttcctggggtttacggtgcaggcggacatggggtgcgtcgtctcatggaatggcaaggaactgaaatgcggatcgggcattttcgtagtcgacaatgtgcacacttggaccgaacagtacaagttccaacctgagagccctgcccgccttgccagcgccatcctaaacgcccacaaggatggggtctgcgggatcaggtccacaacgcgcctcgagaatgtcatgtggaagcagataacaaacgagctgaactatgtcttatgggaaggaggacatgacttaaccgttgtcgcaggcgacgtgaagggagtgctgacaaagggcaaacgcgcactgacgcctcccgttaacgatctcaagtatagctggaagacctggggcaaagccaagatattcacccccgaggcccgcaactcaaccttcctcatcgacggaccggacacatccgagtgtcccaatgaacgccgcgcctggaactttttcgaagtagaggactatggctttgggatgttcaccactaatatctggatgaagtttcgagaagggtcttcagaagtttgtgaccaccgcctgatgtcagcggcgatcaaggaccaaaaggccgtccacgccgacatggggtactggatcgagagctccaagaatcagacctggcagattgagaaggcgtcattgatcgaggtgaagacatgcttgtggcccaagacacacacactgtggtcgaacggggtgctcgagagccagatgctaatcccccgatcgtatgccggcccgttctcacaacacaactaccgccaggggtacgcgacgcagaccgtgggtccttggcacctgggaaaacttgagatcgatttcggtgagtgccccggaacgacggtggcaatccgggaggactgtgatcaccgcgggccctccttacgaaccaccacggctagcggtaagcttgtgacccagtggtgctgcagatcgtgtaccatgcctccccttaggttcctcggggaggacggctgctggtacggaatggagatacggcctctctccgagaaggaggagaacatggtgaagagccaggtaaccgcaggacagggaacgtctgagaccttctcaatggggctgctgtgcctcaccctcttcgtcgaggagtgcttgcgccggcgtgtgactcgtaaacacatgatcctggtggtcgtgataaccttctgcgcgataatcctcggcgggttaacctggatggacctgttacgcgcgctcatcatgctcggcgataccatgagtggcagaatcggtggccagattcacctcgccatcatggcagtgttcaagatgagcccaggatacgtcctgggggtttttctcagaaaacttacttctcgggaaacggcgcttatggttattgggatggccatgacaacggtcttttcgatcccccatgacctgatggaactaatagacggaatctccctgggcctgatactcctcaagatcgttacccatttcgataacactcaggtcggaaccctggcgctttctctgaccttcctacggtccacgatcccgctcgtaatggcctggcggaccataatggccgtttttttcgttgtcacactgatccccttatgtaggacctcgtgcctacaaaagcagtcccactgggttgagatcaccgctctgatccttggggcccaggccttacccgtgtacctgatgacgctgatgaagggggctagccgccgctcctggccgctaaacgagggtataatggcggtcgggctggtgagcttgctcggctccgccttactgaagaacgatgtgcccctcgcgggccctatggtcgccggtggcctattactcgccgcctacgtcatgagcggttctagtgcggacctatccctggagaaggccgcaaacgtgcagtgggacgagatggccgacatcactgggtcaagccccatcatcgaggtcaaacaagacgaggacgggtcattcagcatccgggatgttgaagagacgaacatgatcacactcctggtgaagctcgcgctcattacggtttcagggctataccccctagccatccccgtcacaatggccctctggtacatctggcaggtgaagacccaacgcagcggcgccctgtgggacgtaccctcacccgcggcaacccaaaaggccacgctaagcgagggggtgtaccgtatcatgcaacgcggcctcttcggaaaaacgcaggtcggtgttggcatccacatggaaggggtgttccataccatgtggcacgtaacccgtggttccgtcatatgccacgaaactggccggctcgagccttcgtgggcggacgtgaggaatgatatgatctcctacggtgggggatggagactgggcgacaagtgggacaaggaggaggacgtgcaagtcctcgccatcgagcccgggaaaaaccccaagcacgtgcagactaagcccggtttattcaagactctcaccggggagatcggagcagtgactttggacttcaagccggggacgagcggatcccccatcataaataaaaagggcaaggtgatcggattatacggtaacggagttgtgacgaaaagtggtgactatgttagtgcaatcacccaggctgaacgaatcggggaacccgactacgaggtggatgaagatatttttcggaaaaagcgcctgaccatcatggacctgcaccccggtgcaggcaaaacgaagagaatcctgcccagcattgtcagagaagctctgaaacggcgccttcggactctgattcttgcgcccacgcgtgttgtggccgctgagatggaggaggctttgcgggggttacccatccgctaccagacgccggccgtgaagtcggagcacaccggaagggagatcgtcgatctcatgtgccacgcgacattcaccacccgcttactcagctcaacacgcgtgcccaactacaatctgatagtaatggacgaggcacactttaccgatccgtgctcggtggctgctcgcgggtacataagtacgagggtcgaaatgggcgaggccgcggctatcttcatgaccgccacgcccccgggggccaccgatcccttccctcaaagcaatagccccatcgaggacattgagcgcgagattcccgaacgatcttggaacaccggcttcgactggatcaccgactatcagggcaagactgtctggttcgtgcccagcataaaggcaggcaatgacatcgccaactgcctgcgcaagagcggcaagcgcgtgattcagttgagcaggaagacatttgataccgaataccccaagaccaagttgaccgactgggacttcgtcgtgacaaccgacatctccgagatgggcgccaactttcgcgctggacgggtgatcgacccccgtcgctgcctgaaacctgtaatcctcacagacgggcccgagcgggtaattttggccgggcccattcccgtgactccggcatcagccgcccaaagacgcgggcgtatcgggcgcaacccggcccaggaagacgaccaatacgtattctccggcgaccccctgaagaacgacgaggaccatgcccactggaccgaagcgaaaatgctcctcgataatatctacacacccgagggaattatcccgacgctgttcggccctgaaagggagaagacccaggcgatcgatggagagtttcgcctccgcggagaacagcgcaaaacattcgtggagctgatgaagcggggcgatctccccgtgtggttatcatacaaggttgcctccgctgggatcagctacaaggacagggagtggtgcttcaccggagaacgtaacaatcaaatcctggaggaaaatatggaggttgagatttggaccaaagagggcgagaagaagaaacttcgccccaaatggttagacgctcgggtgtacgcggatccgatggcgttaaaggatttcaaggagttcgcctccggacgcaagagcataacactcgacatcctaaccgagatagcctccttgccaacctaccttagctccaaagccaagctcgcgctggacaacatcgtcatgctacacacgacagagaagggaggccgggcttaccagcacgccctcaacgaattgccggaatcccttgaaacgctcatgctggtggccttgctcggagcgatgaccgcagggatattcttgttcttcatgcagggcaagggcattggcaagctgagcatgggcttgatagcgatagcggttgcctctgggctgctttgggtcgcggagatccagccgcaatggatcgccgctagtatcatactagagttctttctgatggtcctgctcatccccgagcccgagaaacaacgcacacctcaggacaaccagcttatctacgtgatcctgactattctcacaattatcggcctgatcgccgcaaacgaaatggggctaatcgagaagaccaaaaccgactttggcttttaccaggtgaaaaccgaaactaccatcctcgatgtagacctccgcccggcgtccgcttggacactgtacgcggttgcaaccacgatcctgacgcccatgctgaggcacaccatcgaaaacaccagcgccaatctgtctctcgcggcgatcgccaaccaggccgccgtcctgatggggctcggcaagggctggcccctccaccgcatggaccttggggtgccactgctcgccatcggctgctacagccaggtgaaccctacgactctaaccgcgtccctagtcatgctcctcgtacactacgcgattatagggcccggacttcaggccaaggctacgagagaagcccagaagcgcacggccgccggcatcatgaagaacccgacagtcgacgggataaccgtaatcgatctcgagcccatcagttacgacccgaaatttgaaaagcagctggggcaggtgatgcttctcgtgctatgtgtcgggcagctgctccttatgcggaccacctgggccctgtgcgaggtgctgaccctggcgacgggaccagccatgaccctttgggaggggaatcccggacgcttttggaacacgacgatagccgtgtccactgccaacatattcagaggcagctacttagctggggcgggactggccttctcattaatcaaaaacgcccagacgccccgtcgggggacaggcaccacgggcgaaacattgggtgaaaagtggaagagacagctgaactcgctggatcggaaggaatttgaggagtacaagagatccggcatactcgaggtcgacagaacggaggccaagtctgcactgaaagacgggagtaaaattaagcacgcggtcagtcgcggttccagcaagatacggtggatcgtcgaaagggggatggtcaagccgaaaggcaaggtcgtggacctgggctgcggccggggcggctggtcctactacatggccaccctaaagaacgtcaccgaggtgaagggatacaccaagggcggccctggtcatgaggagcctattccaatggcaacctacggctggaacctggtgaaactgcatagcggtgttgatgtgttctacaagcccacggagcaggtcgacaccctcctgtgcgacataggggagtcgagttctaaccccaccatcgaagagggaagaacccttcgcgtcctcaaaatggtcgagccgtggctgagcagcaaacctgagttctgcatcaaggtcctgaacccttacatgcccacggtgatagaagagctcgaaaaacttcagcgccgctacgggggttccctggtccggtgccccctctcaagaaactccactcatgagatgtactgggtctcgggggcctccgggaatatagttagctcggtgaacaccatctcaaagatgctcctgaaccggttcacaacacgccaccggaagcctacctatgagaaagacgtcgacttgggggcgggaacccgctccgtaagtaccgagacggaaaagccggacatgacagtgatcggacggcgtttacagcggttacaggaagagcacaaggagacttggcactacgaccaagagaacccctaccgtacctgggcctaccacgggagttacgaagcccccagcacggggtccgctagctctatggtaaatggtattgtgaagttgctgaccaagccgtgggatgtaatcccaatggtaacccagctagccatgaccgatacgacccccttcggccagcagcgggtgttcaaggaaaaagtggacacccgaacgccccaaccgaaacccggcactcggatgattatgaccactaccgcaaattggctgtgggccctcctgggcaagaaaaagtctccccgtctgtgcacccgagaggaattcatttccaaagtccgcagcaacgccgccatcggagcggtgttccaagaggagcaaggatggacctcggcgtccgaggccgtgaacgacagccggttctgggagctagtcaacaaggagcgcgccctgcaccaggagggtaagtgcgaatcctgtgtgtataacatgatgggcaaacgggagaaaaagctcggggaattcggtcgcgccaaagggagccgcgccatctggtacatgtggttaggcgcgcgcttcttggagttcgaggccctcggatttctcaacgaagatcactggttcagtcgcgagaatagttggtccggcgtggagggtgagggactccaccggctgggctatatcctcgaagacattgacaagcaggacggagacctgatctacgccgacgacaccgccggttgggacacccgcatcacggaggatgacttgctaaacgaggagctgattacagaacagatggcgccgcaccacaagaccttggccaaggccatatttaagcttacataccaaaacaaagtcgtgaaggtcctgcgtcccacaccaaagggcgccgtcatggatatcatcagccgcaaagaccaacggggcagcggacaagtggggacctacggcctgaacaccttcacgaacatggaagtccagcttatccgccagatggaggcagaaggggtgatcacacaggatgacatgcaaaaccccaagggcctcaaagagcgggttgagaaatggctgacagagtgcggcgtggacagactcaagcggatggcgataagcggtgacgactgcgtcgtcaagcccctggatgagagattctccgcgtctctattgttccttaacgacatgggcaaggttagaaaggacatcccgcaatgggagccctcgaaggggtggaaaaactggcaggaggtccctttctgtagccaccactttcacaaaattttcatgaaagacggccgctcgctggtggtgccctgccggaaccaggatgagctcatcgggagagcgcggataagccagggcgccggctggtccctgcgggagaccgcgtgcttggggaaggcttatgcacaaatgtggtcgctcatgtacttccacagacgcgatttgcggctcgcctccatggccatctgcagcgccgttccgacagagtggtttccgacatcgcggacgacctggtccatccacgcgcaccaccagtggatgaccaccgaggacatgctcaaggtctggaatagggtttggatcgaggataatccgaacatgacggacaagacccccgtccactcctgggaagatatcccctatttaggaaaacgcgaggacctctggtgcgggtccctcatcggcctcagctcccgagccacctgggctaagaacatccataccgctataacccaggtgcggaatctaatagggaaggaggaatacgttgactacatgccggtcatgaagaggtacagtgcgccctccgaaagcgagggggtgctctga

SEQ ID NO: 26326 - RNA, 9867 nt, synthetic construct
  misc_feature 1..9867: note = derived and/or modified CDS sequence (opt11) from DENV-4__KC333651__SS-prME
  source 1..9867: mol_type = other RNA
agcaccatgaccctgctctgcttgatccctacggttatggccttccacctgagcacccgcgatggagagccgttaatgatcgtagctaagcacgagcgggggaggcccctgttgttcaagaccacagagggcatcaacaagtgcacactcatcgcgatggacctgggagagatgtgtgaggataccgtcacctacaaatgccctctgctcgtaaacaccgagcccgaggacatcgactgctggtgcaatctgaccagcacctgggtgatgtacgggacctgtacccagaacggagagcgacggcgggagaaacgctccgtggcccttacgccgcacagcggtatgggcctggagacccgtgccgagacatggatgtccagcgagggggcctggaagcatgcccagcgcgtggaatcgtggatcctgagaaaccccggcttcgcgctgctcgccgggttcatggcgtacatgattggccagaccgggatccaacgcatagtcttcttcgtgttaatgatgctggtggcgccgtcctacggcatgcggtgcgtcggcgtggggaatcgcgacttcgtggaaggcgtcagtgggggcgcgtgggtggacctcgtgctggagcacggcgggtgcgtcaccaccatggctcagggcaagcccaccctcgactttgagctcaccaagacgaccgcaaaggaagtggcgctcctgcggacctattgcatcgaggcctctatttccaacatcacgactgcaacccgctgtccgacccaaggggaaccctatctcaaggaggagcaggaccagcaatacatctgccgtcgcgacgtggttgaccggggctgggggaatggctgtggcctgttcgggaaaggcggcgtggtaacgtgcgccaaatttctgtgctccggcaagatcacggggaacctcgtccagattgagaacctagagtacaccgtggtcgtgaccgtccacaacggcgacacccacgccgtaggcaacgacacctccaaccacggcgtgaccgcgactatcacgcccaggagcccctccgtggaggtcaagctaccggactatggagagctcacactggactgcgaacccaggagcggtatcgacttcaacgagatgatactgatgaagatgaagaagaagacctggctcgtgcacaagcagtggtttctggacctgcccctcccctggaccgccggcgccgacacctccgaggtgcattggaaccacaaggagcgcatggtaaccttcaaggtaccgcacgccaagcgtcaggacgtgacggtcctgggtagccaggagggagccatgcactccgccctggcaggcgcaaccgaggtggactcgggcgacggcaaccatatgtttgctgggcacctcaagtgcaaggtgcggatggagaagctgcgcatcaagggcatgagctacaccatgtgttccggaaagttctctattgacaaggaaatggcagagacccagcacgggacgaccgtcgtgaaggtcaagtacgagggcgcaggggctccctgcaaggtcccaatcgaaatccgtgacgtcaacaaggagaaggttgtcgggcgcatcatctcctcaaccccgttcgctgagaataccaactccgtgactaacatcgagctggagccgccctttggggacagctatatcgtaatcggcgttggcgagtccgccctcaccctgcactggttcaggaaggggtccagtattggtaagatgtttgagagcacctaccgcggtgcaaagcgcatggcaatcctgggcgagaccgcgtgggacttcggatccgtgggtggcctcttcacgagccttggcaaggcggtccaccaggtatttgggtccgtgtacaccaccatgttcgggggcgtgtcgtggatggtccgcatcctgatcgggttcctcgtgctgtggatcggcaccaactcccggaacacgagcatggccatgacctgtatcgccgtgggcgggatcacgctgttcctgggcttcaccgtccaggccgacatggggtgcgtggtgtcctggaatggtaaggagctcaagtgcgggagtggcatctttgtggtagacaacgtgcatacgtggaccgagcagtataaattccagcccgagtcccccgctcgcttagctagcgcaatcctgaatgcccataaagacggcgtctgcggcatacggtcgacaacacggcttgagaacgtgatgtggaagcagatcacgaacgagctcaactacgtactgtgggaaggcgggcacgacctaaccgtcgtggctggtgacgtgaagggcgttctgaccaaggggaagcgggcgctgaccccgcctgtgaacgacctcaagtattcctggaagacgtggggcaaggccaagatcttcacgcccgaggcacgcaactcgaccttcctgatcgacggacccgacacctccgagtgccccaacgagagacgcgcgtggaatttcttcgaggtggaggattacggcttcggcatgttcacaaccaacatctggatgaagtttagagagggcagctccgaggtctgtgaccaccgcctgatgagtgccgcaataaaggatcagaaggccgtgcacgccgatatgggctactggattgagtcatcgaagaaccaaacttggcagatcgaaaaagctagcctcattgaagtcaagacctgcctgtggcctaagacgcacacgttgtggagcaacggggtcctggagtcccagatgctgatcccgcggagctacgcgggcccgttctcccaacacaactaccggcaggggtacgctacgcaaaccgtgggcccttggcacctggggaaactcgagatcgactttggcgagtgtcccggcacgacggtggccattcgggaagactgcgaccaccgcggtccgagcctgcgaaccaccaccgcctccggcaagctggtgacgcaatggtgttgccgtagctgcaccatgccgccactccgcttccttggggaggacggctgctggtacgggatggagatccggccactgagtgagaaggaagagaatatggtcaagagccaggtcaccgccggccagggcacctcggagacgttctctatggggctcctgtgcttgaccctcttcgtcgaggagtgcctgcgaagacgcgtgacccggaagcacatgatcttggtagtggtgattactttctgcgcgataatcctaggtgggctgacgtggatggacctgctacgcgcccttataatgctgggcgacaccatgagcggacggattgggggccagattcacttagccatcatggctgtctttaagatgtcccccgggtacgtactgggcgtcttcctgagaaaactgacctcccgggagaccgcgctgatggtcataggcatggcgatgaccaccgtgttctccattccacacgacttgatggaactcattgacggcattagtctcggcctgatccttctcaagatagtgacccacttcgacaacacgcaggtcgggacgctggccctgtccctgaccttcttacgcagcaccattcccctcgtgatggcctggcgaaccatcatggccgttttcttcgtcgtgaccctgatcccgctgtgccgcacctcctgcctccagaagcatagccactgggtggaaatcaccgcactaatcctgggcgcgcaggctttgcccgtctacctgatgaccctgatgaaaggcgcctcccgacgcagttggccgctcaacgagggcatcatggccgtgggcctggtctccctgctcggatcggcgctgctgaaaaacgatgtccccctcgccggacccatggttgccgggggcctgttgctcgccgcttatgttatgtccgggagctccgctgacctccttctcgagaaagccgccaacgttcagtgggacgagatggccgacatcacgggcagctccccgatcatcgaggtgaagcaagacgaggacgggagcttctcaatccgggacgtcgaagagaccaacatgatgacgctgctggttaagctcgccttgatcaccgtctccggcctgtacccgctcgcgatcccagtgacgatggccctgtggtatatctggcaggtcaagacccagcgcagcggggccctgtgggacgtgccgtcccccgccgcaacgcagaaggccaccctcagcgagggggtgtaccgcatcatgcagaggggcctgttcgggaagacgcaagtcggcgtggggatccacatggaaggggtgttccacaccatgtggcatgtgacccggggcagcgtaatctgtcacgaaactgggagactggagccgagctgggccgacgtacggaatgacatgatctcctacggcggaggatggcgactcggcgacaagtgggacaaggaggaggacgtccaagtcctggccatcgagcccgggaaaaatccgaagcacgtgcagaccaaacccgggctgttcaaaacactcacgggagaaatcggcgccgtcaccctggacttcaaaccggggacaagcggctcgcccatcattaacaagaagggcaaggtcattgggctgtatggcaacggggtggtcaccaaaagcggtgactacgtatccgccatcacgcaggcggagcgcatcggcgagcccgactacgaggtggatgaggatatttttcggaagaaacgcctgaccattatggacctgcatccgggcgctggcaagacaaagcggatcctgcccagtatcgtccgcgaggccttgaagaggcgccttcgtacgctgatcctggcccccacccgggtcgtggcagccgagatggaagaggccctacgggggctgcccatccgctaccaaaccccagccgtcaagtccgagcacaccgggcgggagatcgtggacctgatgtgccacgcaacgttcaccacccgccttctgagctccacccgggtccccaactataatctgatcgtcatggacgaagcgcactttacggacccttgtagcgtagccgcccgcggttatatatccactagggtcgaaatgggggaggccgccgcgatcttcatgactgccacgccgccgggggccacggatccgttcccccaaagcaactccccgatcgaggacatcgagcgcgaaatcccggagcggtcgtggaataccggattcgactggataaccgactaccagggcaagaccgtgtggttcgtccctagcattaaggccgggaacgacatcgcgaattgcctacgcaagtccggcaagcgcgtcatccaactgagccggaaaacgtttgacaccgagtaccccaaaaccaagttaacggactgggacttcgtggttacaaccgacatctccgagatgggggcgaactttcgtgcaggcagagtgatagacccccgccgatgcctcaagccggttatactaacggacggacccgagcgcgtgattctggccggccctatccccgtcactcctgccagcgctgcccaaagacgcggccgtatcgggcggaaccccgcccaggaagacgaccaatacgtgttctcaggtgaccccctcaagaacgacgaagaccacgcccattggacggaggccaagatgctgcttgacaacatctacacccccgaggggatcatcccgacactcttcggccctgagagagagaagacgcaggcgatcgacggcgagtttcgcctgcgcggggagcagcgaaagacgtttgttgagctgatgaagaggggtgatcttcccgtctggctgagctacaaggtggcatccgccgggatctcgtacaaggaccgcgagtggtgcttcactggcgaaaggaacaatcaaatactggaggagaacatggaggtggaaatatggaccaaggaaggggagaagaagaagctccgccccaagtggctagacgcaagagtctacgccgatccaatggcgctgaaggacttcaaagagttcgcctccggccgcaagtcgatcacactcgacatcttaacggagattgcctcgctgccaacttaccttagcagtaaagctaagttagccctggacaacattgtgatgctccacacgactgagaaaggagggcgagcttaccagcatgccctgaatgagctgcccgagagcctcgagacactgatgctggttgccctcctgggcgccatgacggcggggatctttctgttcttcatgcagggaaaggggataggcaaactctccatgggcctgatcgccatcgccgtggccagcgggctcctctgggtggctgagatccagccgcagtggatcgcggccagcatcatcctggaattcttcctgatggtgcttctgatccctgagcccgagaagcagcgcacgccccaggacaaccagctgatctacgtcatcctcaccatcttgacgataataggactgatcgccgctaacgaaatggggctcatcgagaagacgaagaccgatttcggcttctaccaggtcaaaacggagaccacgatactggacgttgatctgcgcccggcaagcgcctggaccttgtacgccgttgctaccaccatactgacacctatgctgcggcacaccatagaaaacacatccgccaacttaagcctggcggcgatcgccaatcaggccgcagtgctcatggggcttggcaaaggctggccgctgcaccgcatggacctgggggtaccgctcctggccatcggctgctacagccaggtcaaccccaccacgctgaccgcgtccctcgtgatgctgctggtgcactacgccattattgggcccggcttacaggcgaaggcaacccgggaggcgcagaagcgcaccgctgccggcatcatgaagaaccccacggtcgacggcatcaccgtcatcgacctggagcccatcagctacgatcccaagtttgagaagcaactgggccaggtgatgttgctggtactgtgcgccgggcagttactgctgatgcggaccacttgggccctatgcgaagtgctgacgctagcaactggaccagcgatgacactctgggaaggtaatcccggccggttttggaataccacgatcgccgtgtccacggccaacatcttccgtggcagttacctcgctggggctggcctggccttcagtttgattaagaacgcccagaccccccggcgggggaccggaacgaccggggagaccttgggggagaagtggaaaaggcagctgaactccctcgaccggaaggaattcgaggagtacaagcgctccggcatcttggaggttgacaggaccgaggcgaagagcgccctgaaggacgggtcgaagattaagcacgcggtgagccgcggctcctctaagatcaggtggatcgtggagcgcgggatggtcaagccgaagggcaaagtggtggacttggggtgcggccgaggcgggtggtcctactatatggcaacgctgaaaaacgtcaccgaggtgaaaggttacaccaagggaggcccagggcacgaagagccaatccccatggccacttacggctggaacctggtgaagctccacagcggcgtcgatgtgttctacaaaccgacagaacaggtcgacacgcttctgtgcgatattggggaatccagctccaatcccacgatcgaagagggccgcaccttacgggtcctgaagatggtggagccctggctgagctccaaaccagagttctgcatcaaggtcttaaacccatatatgccgaccgtgatcgaggagctggagaaactgcagcggcgctacgggggcagcctggtgcgttgccccctctcgaggaactccacacacgagatgtattgggtctcaggcgcctctgggaacatcgtgagctccgtgaataccattagcaagatgctgctgaaccggttcaccacgcgccatcggaagcccacgtacgagaaagacgtcgacttgggtgcggggacgcgcagcgtgtctaccgagaccgaaaagccggacatgacggtgatcggccgtaggctccagagactacaggaagagcacaaggagacttggcattatgaccaggagaacccgtaccgcacgtgggcctaccatgggtcctacgaggcacccagtacaggctccgcgagctccatggtcaacggtgtggtaaagctcctgacgaaaccgtgggacgtcatccccatggtgacccaactggcgatgaccgacaccacccccttcgggcagcagcgggtattcaaggaaaaagtagatacgcgcacgccccagccgaagccaggcacccgaatgatcatgacgactaccgcgaactggctctgggccttactgggaaagaagaagtccccgcgcctttgcacgcgggaggagttcatctccaaggtgagaagcaacgccgccatcggcgccgtttttcaagaggagcaagggtggacgtccgcaagcgaagctgtcaatgacagtcggttttgggagctggtggacaaggagcgcgccctgcaccaagagggcaagtgcgagagctgcgtgtataacatgatgggcaaacgtgagaaaaagctcggagagttcggccgcgccaaggggtctcgggccatctggtacatgtggctgggtgcgagattcctggaatttgaggccctcggattcctgaacgaggaccactggttcagtcgcgagaacagctggtccggcgtcgagggcgaggggctgcaccggctcggctatatcctggaggacatcgataaacaggagggtgacctgatctatgccgacgacaccgcgggatgggatacccgtataactgaagacgacctcctgaacgaggaactgatcacggagcagatggcaccccatcacaagaccctcgctaaggccatcttcaagctcacgtaccagaataaggtagtgaaagtcctgcggcccacccccaagggcgccgtgatggacataatcagccgcaaagaccaaagggggtccggacaggtggggacgtacggcctaaacaccttcaccaacatggaagtccagctgatccgccagatggaggccgaaggggtgattacgcaggacgacatgcagaaccccaagggcttgaaggagcgggtggagaagtggctcaccgagtgcggcgtcgaccggctgaagcggatggcgataagcggggacgactgcgttgtgaaaccccttgacgagcgcttcagtacaagccttctgtttctgaatgacatgggcaaggttagaaaggacataccgcaatgggagccctcgaaggggtggaagaactggcaagaagttccgttctgcagccaccacttccataagatattcatgaaggacggccgctccctcgttgtcccctgtcgcaatcaggacgagctcatcgggcgcgccaggatctctcagggagcgggctggtccctgcgcgagaccgcctgcctcgggaaggcctatgcgcagatgtggagcctgatgtatttccaccgacgcgatctgcgattggcctccatggcgatctgcagcgccgtgccaacggagtggtttcccacctcccgcacgacctggtcgatccacgcgcaccaccagtggatgacgacagaagacatgctgaaggtgtggaacagagtttggatcgaagacaacccaaacatgacggacaagacccccgtgcatagttgggaggacatcccgtatctgggcaagcgtgaagacctctggtgtgggtcgttgatcgggctgtcgagtcgcgcgacctgggccaagaacatccacaccgccatcacccaggtgcggaacctcatagggaaggaagactacgtcgactacatgcccgtgatgaagaggtatagcgcgccctccgagagtgagggtgtgctgtga

SEQ ID NO: 26327 - RNA, 9867 nt, synthetic construct
  misc_feature 1..9867: note = derived and/or modified CDS sequence (opt11) from DENV-4__JN559740__SS-prME
  source 1..9867: mol_type = other RNA
tcgacaattacactactatgcctaattccgaccgtcatggccttccacctaagtacgcgagacggggaaccactaatgatagtagcgaaacacgaacgagggaggcccctgctgtttaaaacaacagaaggaataaataaatgcacactcatagcgatggacctgggagaaatgtgtgaggatacagtcacatacaaatgcccgcttctcgtaaacacagaaccggaggatatcgattgctggtgcaacttaacaagtacatgggttatgtatggaacgtgcacacaaagtggagaaagaagaagggagaaaagaagcgttgcactaacgccccactcagggatggggctggaaacaagggcagagacatggatgtcatctgaaggagcgtggaaacacgcccagcgcgtggaaagctggatacttcgaaaccccggattcgcactcctggcaggattcatggcatacatgatcggccaaacaggcatacaaagaactgttttcttcgtattaatgatgctcgtagccccaagctatggaatgagatgcgttggcgtggggaatcgcgacttcgtcgagggcgtttccggaggcgcatgggtagatctggtactcgaacacggcggctgtgtaacgacaatggcacagggaaaaccgaccctagacttcgagttaacgaaaactaccgcgaaagaggtcgcgttgctacgaacatactgcattgaggcaagtataagcaacataaccacagcgacccggtgccccacacaaggggaaccgtacctaaaagaagaacaagatcaacaatatatatgcagacgcgacgtcgtagacaggggttgggggaatggctgtggcctattcggaaaaggaggtgtagtcacgtgtgcaaaattcagttgttcaggaaagataacggggaaccttgtccagatcgaaaacttggaatacacggtcgtcgtgacagtccacaacggcgacacacgcgcagtagggaacgacatatcgaatcacggcgtcaccgcgatgatcacaccacgctcgccatcagtcgaggtaaaattacccgactacggagaactcaccctagactgcgaaccgcgaagcggcatagacttcaacgaaatgatacttatgaaaatgaaaaagaaaacttggctcgtccacaaacaatggttcctagacctcccattaccctggacggccggggcggacacctctgaagtacactggaactacaaagaacgaatggttactttcaaagtaccgcacgcgaaaagacaggacgtcacggtcctcggatcacaagagggagcgatgcacagcgccttagcaggagcaacagaagtcgatagcggtgacgggaatcacatgttcgccggtcacttaaaatgcaaagtaagaatggagaagttgcggattaaaggaatgtcctacacaatgtgcagcgggaaattcagcatcgataaagagatggcagaaacccaacatggaactacggtggtgaaggttaaatacgaaggcgccggggccccatgcaaagtacccatcgagattagagatgtcaacaaagagaaggtagtgggcaggattataagcagcacacccttagccgaaaatacaaactccgtaacaaatatcgagttagaaccacccttcggggactcctacatagtaatcggggtgggaaacagcgcattaacgttacattggttccgtaaggggtccagcatcgggaagatgttcgaaagcacctatcgcggtgcgaaacgtatggcaatactcggtgagactgcctgggacttcgggagcgtgggcggcttattcacatcactcgggaaagcggtccaccaggtttttgggtcggtgtatacaacgatgttcggcggagtcagttggatgataaggatcctcattggcttcctagtactttggatcgggaccaactcgagaaacacttcaatggctatgacatgcatagccgtcgggggcatcacgctgttccttggtttcacagtccaagcagacatgggctgcgtagtgagctggtccggcaaagagcttaaatgcggaagcgggatattcgttgtcgacaacgttcatacgtggacggagcaatacaaatttcaaccagaaagtcctgcccgcctagcgtcggcaatactgaacgcccataaagacggagtgtgcgggatcagatcaacaacccgactagaaaacgtcatgtggaaacagatcactaacgagctcaattacgtgctttgggaaggcggtcacgacttaacggtcgtcgcaggagacgtgaaaggtgttctgacaaaaggaaagcgagctctaactccacccgtgagcgatctcaaatactcatggaagacatggggcaaggctaaaatattcacaccagaagccagaaactcgacattcctgatagacgggccagacacctccgagtgcccaaacgaaagacgagcatggaacagtctcgaggttgaggactacggtttcggcatgtttacgacaaatatctggatgaaattccgcgaaggctcgtcggaggtctgcgatcaccggttgatgtcggcagcaataaaggaccagaaagccgttcacgccgatatgggctactggatcgagtctagcaaaaaccaaacgtggcagatagaaaaagcatccctgatagaggtaaaaacgtgtctatggccaaagacccacacactatggtcaaacggcgtcctagaaagtcaaatgcttataccaaaaagctacgctgggccgttcagccagcataactacaggcaggggtacgccacccaaaccgtgggcccatggcatctggggaaactagagattgactttggagagtgccctgggacaacagtaacaatccaggaagattgcgaccaccgaggaccctccctgcgcaccacgacggcctccggcaagctagtcacgcaatggtgctgccggtcctgcacgatgccaccccttcgtttcctgggcgaagatggctgttggtatggcatggagattagaccactgagtgagaaggaagagaacatggtcaaatctcaagtaacagcgggccaaggcacctctgagacattttctatgggactcctttgtttaacacttttcgtggaagagtgcttacgaaggcgggtcacgcgaaaacacatgatattagtcgtggtcattaccttatgcgcgattatcctcggcggattaacatggatggaccttttacgcgccctcatcatgctgggcgacaccatgagcggcaggataggcgggcaaatccacctcgccatcatggctgtctttaaaatgtctccggggtatgtactcggcgtcttcctcagaaaactaaccagcagggaaacggcattgatggtaatcggaatggcgatgacgacagtactttctataccacacgacctaatggaactcatcgacggcatctcattagggctaatactgttgaaaatcgtaactcaattcgacaacacacaggtaggcacattggcattaagcctaacgtttattcgctccacaatgccacttgtcatggcttggcggactataatggccgtcctcttcgtcgtgaccctcatacccctctgccgcacctcatgtctccagaaacagtcccactgggtagagattacggcgctcatcctaggcgcacaggcactacccgtctaccttatgacactgatgaagggcgcatcaagacgcagctggccgctcaacgagggtatcatggcagtagggttagtgtcgctcctgggaagcgcactcctcaaaaacgacgtcccactagctggaccgatggtagctggcggactgctgctagccgcgtatgtaatgagcggtagctccgccgacctgagcctcgaaaaggcggctaacgtccaatgggacgaaatggcagacataacaggctccagtccaataattgaagtgaaacaagacgaagatggttcgtttagtatccgagacgtcgaggagacaaacatgataacgctgctcgtaaaactcgccctcataaccgtcagcggactgtatcccctcgcaattccagtcactatgacactctggtatatgtggcaggttaagacccagcggtccggggcgctatgggacgtgccgagcccggcggcaactcaaaaggccgccctctccgagggtgtttaccggataatgcaaagaggccttttcgggaagacgcaagttggagtgggtatccacatggagggagttttccacacaatgtggcacgtcacacgaggatcggtcatatgccatgaaaccggccgcctggaaccgtcatgggccgacgtaagaaacgacatgatctcgtacggaggagggtggcgcctcggcgacaagtgggacaaggaggaagacgtacaagtcctcgctatagaaccaggcaaaaaccccaagcacgtccagacaaaaccaggactgttcaagaccctcacaggcgagatcggcgcagtgacattagacttcaaaccaggaacctcaggctcaccgataatcaacaggaagggcaaggtcatcggcctgtacggcaacggggtggtgaccaaatcaggtgattacgtatcagcgatcactcaagcggagcgaataggagaacccgactatgaagtagatgaagacatcttcagaaagaaacggctcacaatcatggacctgcacccaggggccggaaaaacgaaacgaatattaccgagcatcgtaagagaagcattgaagagacgcctaaggacactaatcctcgctcctacgagagttgtagccgcggagatggaagaggctttaaggggactcccaatcaggtaccagacccctgcagtcaaatccgagcacacaggtagggagatagtcgatctgatgtgtcacgccactttcaccacaaggctgctgagcagcacacgcgttccgaactataacctcattgttatggatgaggcacatttcacagaccccagctctgtggcagcgcgcggatatatcagcacgagagtagagatgggcgaagccgccgcgatattcatgacggccaccccgcccggtgcaaccgatccctttccacaatcaaattcccccatagaggatatcgagcgggagattccagagaggagctggaacacagggttcgattggataacggactaccagggcaaaacagtctggtttgtgccttccatcaaggctggtaacgacatcgcaaactgtctccgaaaaagcgggaagaaagtcatccagctgagtagaaaaacattcgacacggaatacccaaaaaccaagttgacggactgggactttgtagtcaccacggacatcagcgaaatgggggcaaacttcagagccgggcgtgtaatagacccaagaaggtgtctaaaacccgtaatcctaaccgatggtccagagagggtaatcctggcaggaccgattccggtaaccccggcatccgcggcacagcgacgcggaagaatcgggaggaacccagcgcaagaagacgaccagtacgtcttctcaggggatccactcaagaacgacgaagaccacgcacactggaccgaggcaaagatgcttctcgacaacatttacaccccagaaggcatcataccaactctgttcggccccgagcgggagaaaacacaagcaattgatggcgagttccggctaagaggcgaacaaagaaaaacgttcgtcgaattaatgagaaggggagatctcccagtctggctttcatataaggtagcatccgcggggatctcatacaaagaccgagaatggtgcttcactggggagcggaacaaccaaatactggaggaaaacatggaggtcgagatatggactcgtgaaggagagaagaagaaacttcgcccccggtggctagacgcccgagtctacgcagatcccatggcactaaaggacttcaaagaatttgcaagtggacggaaaagcataacattagacatactgacggagattgcaagcctacctacgtacctgtctagccgcgcgaaacttgcgctcgacaacatagtgatgctgcataccaccgagagaggcggacgagcataccaacatgctctaaacgaactgccagaatccctagaaaccctgatgctcgtcgcattgctcggtgcaatgacagcaggcatattccttttctttatgcagggcaaaggcatcggcaaactctctatgggactgatcacaatagcagttgcttcgggactactctgggtggcggaaatacagccacagtggatagcagcaagcataatactagagtttttcctcatggtcctcttaatccctgagcccgaaaagcaacgtacgcctcaagacaaccagctgatctatgtcatacttacaatacttacaataattgggctcatagcagcgaacgagatgggcctaatagaaaagacaaagacagacttcggattctaccaagtcaaaaccgaaacgacgatcctggacgtcgacctaaaaccggcatcagcctggaccctctacgcagtagctacgactatactgaccccaatgctacgccacaccatcgaaaacacctctgctaacctgagtctggcagccattgcgaaccaagccgcggtcctgatgggcttgggcaaaggctggccgctccacaggatggacttaggcgtgccactactagccatgggatgctactcccaagtgaaccctataacattgacagcaagcctggtcatgttactcgttcattacgcaataatcggaccagggctacaggcgaaggcaacacgggaagctcagaaaagaacagcagcgggtatcatgaagaatccaacggtagacggcataacagttatcgacctggagccaatctcttacgaccccaaattcgagaaacagctaggccaagtcatgctcctagtcctatgtgcggggcaactgctgctgatgcgtacaacatgggccttttgtgaagtcctcaccctcgccacgggccccatcctaacactatgggaaggaaacccagggcggttctggaacaccacgatcgccgtcagcacagcaaacatattccggggctcttaccttgccggcgccgggttagcattctccctaatcaaaaacgttcagacgccgcggcgaggtaccggaacaacgggagaaacgcttggtgaaaaatggaagcggcagcttaacagcctagaccgcaaggaatttgaggagtataaacgaagtggtatattggaagtagatcgcacagaagcaaaatcagcactgaaagacgggtcgaagataaagcatgcagtatctcgggggagcagcaaaatcagatggatagtagagcgcggcatggtaaaaccgaaaggcaaggtcgtcgacctcggctgcggacgcggtggttggagttactacatggcaacgctaaagaacgtcacagaagttaaaggttatacgaaaggcggaccgggccacgaggagccaatcccaatggcgacttacggatggaacttggtaaaactacacagcggagtggatgtcttctacaagccaactgaacaagtggatacacttttgtgcgacatcggcgaatctagcagtaacccgactatagaagaagggaggacattacgagtcctcaaaatggtcgagccttggcttagctctaagcctgagttctgcattaaggtactcaacccctacatgccaacagtcatagaggaattagaaaaacttcaaagaaaacacggagggaaccttgtcagatgcccactctctcgcaattccacgcatgagatgtactgggtatcgggggcctcaggaaacatagtttcatccgtgaatacaacctctaaaatgctcctaaacagatttacaaccagacacagaaaacccacgtatgagaaagacgttgatttaggcgccggcacgagatccgtgtctaccgagacggaaaaacccgatatgacaattatcggacgaaggctacaacgcctgcaagaggagcacaaagaaacatggcattacgaccaggagaacccctatcgtacatgggcctatcacggttcctacgaggccccctcgacaggcagtgcatcgagtatggtgaacggagtagtaaagctcctcactaagccgtgggacgtaatacctatggtgactcagctggcaatgacagacacgacgccatttgggcagcagagggtgtttaaggagaaggtagacacacgcacaccccagcccaagcccggaacgcgtatggtgatgaccacgacagcgaactggctctgggccctactgggaaagaagaaaaatcccagactttgcactcgagaagagttcatcagcaaagttcgttctaacgccgcgatcggagcagtcttccaagaggagcaaggttggacctcggcctcggaggcagtcaacgacagccggttctgggaactggtagacaaagaacgtgccctccaccaggaggggaaatgcgaaagctgcgtatacaacatgatgggaaagagggagaagaaactaggggagttcggccgcgcgaagggcagccgcgcgatctggtacatgtggctaggagcacggttcctggagtttgaggccctcggatttttaaacgaagatcactggtttggaagggaaaattcctggagcggggtagaaggagaaggcctccaccgcttaggatacatccttgaggaaattgacaagaaagacggggacttgatgtatgcagacgacaccgcagggtgggacacgagaatcaccgaagatgatctccaaaacgaggagctcataaccgaacagatggctcctcatcataaaatactcgcaaaggccatctttaagctcacataccagaacaaagtagtcaaagtcctccgccccacgcccaggggtgctgtcatggacataatatcccgaaaggaccaaagaggaagtggacaggtgggcacctatggcctgaacacattcacaaacatggaggtacaactaatacggcaaatggaagcagagggggtaataacccaggatgatatgcaaaaccctaaaggcctcaaagagagggttgaaaaatggcttaaggagtgcggggtagacagactcaaaaggatggcaataagtggggacgattgtgttgtaaaacccttagacgagaggttcggcacaagcctcctttttctaaacgacatggggaaggtgcggaaagacatacctcaatgggagccgagcaaagggtggaaaaattggcaggaagtaccattttgctcccaccactttcacaaaatatttatgaaggatggacgctccctggtagtcccatgccgaaaccaggacgagctaatcggtagagcaagaattagccaaggggcaggctggtcattacgtgaaaccgcatgcctggggaaggcgtacgcccaaatgtggagtctaatgtatttccatagacgcgatctacgactcgcaagcatggcaatctgctcggcagtgcccactgaatggttccctaccagccgtactacgtggtcaatccacgctcaccatcagtggatgaccacagaggacatgctaaaggtatggaatcgagtatggatagaagataaccccaatatgacagacaagacaccggtccacagctgggaagacataccctacctggggaaaagagaagacctctggtgcggatcactaataggattgtcgtcaagagcaacttgggcgaaaaacatacacaccgcgataacacaagtaaggaacctgattggaaaagaagagtacgtagactacatgcctgtcatgaaacggtacagcgcacctagtgaaagcgagggcgtactctaa

SEQ ID NO: 26328 - RNA, 9867 nt, synthetic construct
  misc_feature 1..9867: note = derived and/or modified CDS sequence (opt11) from DENV-4__JN559741__SS-prME
  source 1..9867: mol_type = other RNA
tccaccatcaccctgctctgtctgatccccacggtgatggccttccacttgagtacccgcgacggcgagccgctgatgatagtcgccaaacacgagcgggggcgcccccttctgttcaagaccacggagggcatcaacaagtgcacgttgatcgcgatggacctaggggagatgtgcgaggacaccgttacgtacaagtgtccgctattagtgaacacggagcccgaggacatcgactgctggtgcaacctgacgtcgacgtgggtcatgtacggaacctgcacccaatccggggagcggcgccgggagaagaggagcgtagccctgacgccgcactccggcatgggattagagacccgggctgagacctggatgagctccgagggggcgtggaaacacgcccagcgcgtggagtcgtggatcctccgaaacccgggtttcgcgttactggccgggttcatggcctacatgatcggccagaccggcatccagcgcacggtcttctttgtgttaatgatgctggtggccccttcctacggcatgcggtgcgttggcgtagggaatcgcgacttcgtggagggcgtcagcggcggtgcgtgggtggacctcgtactggagcacggcgggtgcgtcaccaccatggcacagggaaaacccacccttgacttcgagctcacgaagaccacggcaaaggaggttgccctactgcgtacctactgcatcgaggccctgatctccaacataacgaccgcgacccgatgcccgacccagggcgagccctacctgaaggaggagcaggaccagcagtatatctgccggagagacgtggtcgaccggggctggggtaacgggtgcggcctgttcggtaaaggcggggtcgtgacatgcgcgaagttcagctgctccggcaagatcaccggtaacctcgtacagatcgagaatctggagtacaccgtggttgttaccgtgcacaacggcgacacgcacgccgtcggcaacgacaccagcaaccacggggttacggccacgattacgccccgttcccccagcgtggaagtcaagctgccagactacggagagctcactttagactgcgagccccggtccgggatcgacttcaacgaaatgatcctgatgaagatgaaaaagaagacctggctcgtgcacaagcagtggttcctggacctaccactcccttggaccaccggcgccgacacgagcgaggtccactggaactacaaggagcgcatggtcacgtttaaagtgccgcacgcgaaacggcaggacgtgaccgtgctggggtcccaggagggtgctatgcacagcgccctggccggcgccaccgaggtggacagcggggacggcaaccacatgttcgcggggcacttgaagtgcaaggtgcgcatggagaagctgcgcatcaagggcatgtcctacacgatgtgcagtgggaaattttccatcgacaaggagatggcggagacccaacacgggaccaccgtcgtgaaggttaagtacgaaggcgcaggggccccgtgcaaggtgcccatcgagatccgggacgtgaacaaggagaaggtggtgggccgcgtgattagcgccacacccctggcggagaacaccaactccgtgaccaacattgagctcgagcctccctttggcgacagctatatcgtcatcggggtgggcaactccgccctgactttacactggttccggaagggtagttcgatcggcaagatgttcgagagcacgtaccgcggggcgaagcggatggccatcctcggcgagaccgcgtgggatttcgggtccgtcggtggcctgttcaccagcctggggaaagctgtccaccaggtgtttggatccgtgtacaccacgatgttcgggggcgtctcttggatgatccgcatcctaatcgggttcctggtgctatggatcggcaccaattcacgtaacaccagcatggccatgacatgcatcgccgtgggcgggatcacgctgttcctcggcttcaccgtccaggccgacatggggtgcgtggtgtcctggagtggcagggagctgaagtgcgggtccggcatcttcgtcgtggacaacgtgcacacctggacggagcagtacaagttccagcccgagagcccggcgcggctggcaagcgccatcctcaacgcccacaaggacggcgtctgcgggattaggtccacgactcggctggaaaacgtgatgtggaagcaaatcaccaacgagctgaactacgtactctgggaaggtggacacgacttgacggtcgtggcgggggacgtgaagggcgtcctgactaaggggaagcgcgcactcaccccgcctgcgagcgacctgaagtactcctggaagacctggggcaaggccaagatcttcactccggaggcccggaactcgacgttcttaatcgacgggcccgacacctccgagtgcccgaacgagcgacgggcctggaacagctttgaggtggaggactatggcttcgggatgtttaccactaacatctggatgaagttcagagagggctccagcgaggtgtgtgatcatagattaatgtccgcggctatcaaggatcagaaggcggtccacgcagacatgggctattggatcgaaagctccaagaaccagacgtggcagatcgagcgcgcgagcctcatcgaggtgaaaacgtgtctttggcccaagacccacaccctatggtcgaacggggtgttagagagccagatgttaatacccaagtcctacgccggcccgtttagccagcataactaccgacaagggtacgccacccagacagtaggtccatggcacctcgggaagctggagatcgatttcggggaatgcccgggcaccaccgtaaccatccaggagaactgcgatcaccgcgggcccagtctgcgcacgaccaccgcctctggcaagctcgtgacccagtggtgctgccggagctgcacgatgccgcccctgcgcttcctgggggaggacggctgttggtacgggatggagatcaggcccctctccgagaaagaggagaatatggtcaagagccaggtcaccgccgggcagggtacctccgaaacgtttagcatgggtttgctgtgcctaaccctgttcgtcgaggaatgcttgcgccggagagtcacccggaaacacatgatcctcgccgttgtcatcaccctgtgcgctatcatcctagggggcttaacctggatggacctgctgcgtgccctcataatgctgggcgacaccatgtcgggtcggattgggggccagacccacctggccatcatggccgtgttcaagatgagccccgggtacgtactcggcgtcttcctacgcaagctgacctccagagagaccgccctgatggttatcggtatggccatgacgacaaccctgagcattccccacgatctcatggaactcattgacggcatctccctgggcctgatcctcttgaaaatcgtgacccagttcgacaacacgcaggtcgggaccctggccctcagcctgacctttatcaggtccaccatgagcctcgtgatggcctggagaacgatcatggccgtgctattcgtcgtgacactgatccccctgtgccgcacctcctgcctccagaagcagagtcactgggtcgaaattaccgcgctgatcctgggagcacaggccctccctgtctacctgatgacactgatgaagggcgcctcccgacgcagctggcccctcaacgagggcatcatggcggtgggactggtgtctctgctcggcagcgccctgctcaagaacgacgtcccgctcgccggcccgatggtggcagggggcctgctgctcgcagcttacgtgatgtccgggagctcagccgacctgtcgcttgagaaggccgccaacgtgcagtgggacgagatggccgacatcaccggcagctcccccatcatcgaggtaaaacaggacgaagacgggagcttctccatccgggacgtggaggagactaacatgatcaccctcctggtcaagctggcgctcatcaccgtgagcggattgtaccccctggccatcccgatcaccatgaccctctggtacatgtggcaagtgaagacccaacgctccggcgccctgtgggacgtcccctcgccagccgccacccagaaggcggccctgagcgagggggtgtatcggatcatgcagcgcggtctcttcggtaagacacaggtgggcgtcgggattcacatggagggcgtgttccacaccatgtggcatgtcactcggggcagcgtcatctgccacgaaaccggacgactcgagccctcctgggccgacgtgcggaacgacatgataagctacggcgggggctggcggctaggcgataagtgggataaggaggaagacgtgcaggttttagccattgagccggggaagaaccccaagcacgtgcagacgaagcccggcctgttcaagaccctgacgggggagatcggcgctgtgacgctcgacttcaagccgggtacgtccggcagcccgattatcaaccgcaaaggcaaggtcatcgggctctacggcaacggggtggtgactaagtccggggactacgtcagcgcgatcacccaggccgaacggatcggggagcccgattacgaggtggacgaggatatcttcaggaagaagcggctgaccatcatggacctccaccccggcgcgggaaagacgaagcgcattctgccgtccatcgtacgagaggccctaaagaggcgtctccgcaccctcatcttagcacccacccgggttgtggcagccgagatggaggaggccctgagggggctcccgatccggtaccaaacccccgctgtgaaatcggagcacacggggcgagaaatagtcgaccttatgtgccacgcgacctttaccacccggctgctctccagcacgcgcgtgccgaactacaacctgatcgtgatggatgaggcccacttcaccgaccccagctccgtagccgcccgtgggtacattagcactcgcgtggagatgggcgaggccgctgccatcttcatgaccgctacgccacccggggccacagacccattccctcaatccaacagccccatcgaagatatagagcgggagatccctgagcgatcgtggaatacgggctttgactggatcaccgattaccagggcaagacggtgtggttcgtgccgagtatcaaagccgggaacgacatcgcgaactgcctgcgaaagtccggcaagaaagtgattcagctcagccggaagaccttcgacacggagtacccaaaaaccaagctgacggactgggacttcgtcgtgaccaccgacatatccgaaatgggggcaaacttccgcgccggccgggtgatcgacccccgacggtgcctcaagcccgtcattttaaccgacgggccggagcgcgtgatcctggcgggccccatccccgtgacgcctgccagtgccgcccagcggcgcggccggatcgggcgcaacccggcccaggaggacgaccaatacgtcttttccggcgatcccttgaagaacgatgaggatcacgctcattggaccgaggctaagatgctcctggacaacatttacacccccgagggcatcatccccactctgttcggacccgagcgggaaaagactcaagccatcgatggcgagttccgcctccggggcgagcagcgcaagacgtttgtggagctgatgcggcgcggagacctgcccgtgtggctctcatacaaggtcgcctccgccgggataagctacaaggaccgggaatggtgttttaccggggagcgcaacaaccagatcctggaggaaaacatggaggtggagatctggacccgggaaggggagaagaagaagctgcgacccaagtggttagacgcccgggtgtacgctgaccccatggccctgaaggacttcaaggagttcgccagcgggcgaaagagcatcaccttggacatcctcacggaaatcgcctccctgcccacctacctgagctcccgcgcgaagttagcattagacaacatcgtcatgctgcacaccaccgagcggggagggcgcgcgtaccaacacgcccttaacgagctgcccgagagcctggagacactcatgctggtggccctgctgggcgctatgaccgccgggatcttcctcttcttcatgcagggcaaggggatcgggaaactgagcatgggcctcatcaccatcgccgtcgcctccgggttactttgggtagcggagatccagccccagtggatcgcggccagcatcatcctcgagttcttcctgatggtgctgcttatcccggagcccgaaaagcagcggaccccgcaagacaaccagcttatctatgtgatactgactatcctcaccatcatcggcctcatagccgcgaatgaaatggggctaatcgaaaagaccaagaccgacttcggattctaccaggttaaaacggagaccaccatactcgacgtagacctgaggcccgcctccgcctggaccctgtacgccgtggccacgactatcctcaccccgatgctgcggcacaccatcgagaacaccagcgccaacttgtccctcgccgcgatagccaaccaggctgccgtcctgatggggctgggcaagggttggcccctccaccgcatggatctgggggtgcccctgctcgcaatgggctgctacagccaggtgaacccgaccacccttaccgcgtcgctggtcatgctcctggtccattacgccatcatcggaccgggacttcaggccaaggccacgcgggaggcgcagaagcgcaccgcagccggcatcatgaagaaccccaccgtggacgggatcaccgtcatcgacctcgagccgatcagctatgaccccaagttcgagaagcagctggggcaagtgatgctgctcgtgttgtgcgctggccagctgcttctcatgcggacgacttgggccttctgcgaggtcctgaccctcgcgacgggcccgatcctgacgctgtgggaggggaaccccggccgcttctggaacaccacaatcgccgtgtccaccgccaacatcttccggggcagctacctcgccggggccggcctggcgttctccctgatcaagaacgcgcaaacgcctcgtagggggaccggcaccgccggagagaccctcggagagaagtggaagaggcagctgaacagcctggaccggaaggagtttgaggagtacaagcgcagcggtatactcgaggtggaccggaccgaggccaagagcgccctgaaggatggttccaagatcaaacatgcggtcagcagaggctccagcaagattcggtggatcgtggagcgcgggatggtgaagcccaagggtaaggtagtcgacctgggctgcggccgcggcgggtggtcctactacatggccacgctcaagaacgtcaccgaggtcaagggatacaccaaaggagggccggggcacgaggagcccatccccatggccacctacgggtggaacctggtgaagctgcatagcggcgttgacgttttctacaagcccacggaacaggtggatactctgctctgcgacatcggcgagagctccagcaatccgaccatagaggaaggccggaccctgagggtcctcaagatggtggagccctggctgtccagcaagcccgagttctgcatcaaggtgctgaacccctacatgccgacggtgatcgaggaactggagaagctccagcggaagcacgggggcaacctggtccgctgtccgctgtcccgtaacagcacccacgagatgtactgggtgtccggcgcctccgggaacattgtctccagcgtaaacaccaccagtaagatgctcctgaaccgcttcacgacccgtcaccgaaagccaacctatgagaaggatgtggatctgggcgcggggaccagaagcgtctccacggagactgagaagcccgacatgaccatcatcggtcgacggctccagcgccttcaggaggagcacaaggagacctggcactatgaccaggagaacccataccggacgtgggcctatcacgggagctatgaggccccctcgaccggctccgcctcctcgatggtgaacggcgtggtcaagttgctcaccaagccttgggacgtgattccgatggtaacacagcttgccatgacagacacgaccccattcgggcaacaacgagttttcaaggagaaggtagacacccggacgcctcaacccaagccaggaacccgcatggtgatgaccaccacggcgaactggctgtgggccctcctgggaaagaagaagaacccccggctgtgcacccgcgaggagttcatatccaaggtccgcagcaacgccgccatcggcgcggtgttccaggaggagcaggggtggaccagcgcgtcggaggccgtaaacgatagccgcttctgggagctcgtcgacaaagaacgggcactgcaccaggagggcaagtgcgaatcctgcgtgtacaacatgatgggcaagcgcgaaaagaagctgggagagttcgggcgtgcaaaggggagccgggcaatctggtacatgtggctcggcgcgcgcttcctggagttcgaggcccttgggttcctcaacgaggaccattggttcggtagggaaaattcctggtccggagttgaaggggaaggcctgcaccgcctgggctacatcctcgaggagatcgacaagaaggacggcgacctgatgtacgccgacgacacagctggctgggacacgcggatcacagaggacgacctgcagaacgaggagctgattaccgaacagatggcgccgcaccacaagattctagccaaggccatcttcaagctgacctaccaaaacaaggtcgtgaaagtgctcagacccactccgagaggggccgtcatggacataatctccagaaaggatcagcggggcagtggacaggtgggcacgtacggcttgaatacattcaccaacatggaggtgcagctgatcagacagatggaggccgagggcgtcatcacccaggacgacatgcagaatcccaagggcctcaaggaacgggtggaaaagtggttacgagagtgcggagtggaccggctgaagcgcatggcgatatccggcgacgactgcgtcgttaagcccttagacgaacggttcgggacgagcctgctgttccttaatgacatgggcaaggtgcgaaaggacatcccccagtgggagccgtccaaggggtggaagaattggcaggaggtccccttctgcagccaccacttccacaagatctttatgaaagacggccgttccctggtggtgccctgccgcaaccaggacgagctgattggccgggcccgcatcagccagggggccggctggtccctacgcgagaccgcctgtctggggaaagcctacgctcagatgtggagcctgatgtacttccacagacgcgatctgcggctggcctccatggcaatctgctccgcggtgcccactgagtggttcccgaccagccgcacaacctggtccatccacgcccaccaccagtggatgactaccgaggacatgcttaaagtgtggaaccgggtgtggatcgaggacaaccctaacatgattgataagacgccggtccattcctgggaggacatcccctaccttggcaagcgagaggatctgtggtgcgggtccctgatcggcctcagctctcgggcgacttgggccaagaacatccacaccgcgatcactcaagtgcgcaacctgatcggtaaggaggagtacgtggactacatgccggtcatgaagcggtacagcgccccctccgaaagcgagggggtgctgtag

SEQ ID NO: 26329 - RNA, 9867 nt, synthetic construct
  misc_feature 1..9867: note = derived and/or modified CDS sequence (opt11) from DENV-4__JQ513334__SS-prME
  source 1..9867: mol_type = other RNA
agcaccatcacgctgctctgcctgatcccgaccgtgatggccttccacctgtccacccgcgacggggagccgctcatgatagtggccaagcatgagcgggggcgccccctgctgttcaagaccaccgagggtataaacaagtgcaccctcatcgccatggacttaggggagatgtgcgaggacaccgtgacctacaagtgccccctgctcgtgaacaccgagcccgaggacatcgactgctggtgcaacctaacgagcacctgggtaatgtatgggacctgtacccagtccggtgaacggcgccgggagaaacgcagcgtggccctgacgccgcactccggcatgggcttggagacccgcgccgagacgtggatgagctccgagggggcctggaagcatgcccaacgcgtggagtcctggatactccggaacccgggcttcgcgctgctcgctggtttcatggcctacatgatcggccagacggggatccagcgcaccgtcttcttcgtgctgatgatgctggtggcccccagttacggcatgcgatgcgtgggggtcgggaaccgcgatttcgtcgagggcgtcagcggaggcgcttgggtggacctcgtactggagcacggcgggtgtgtgaccacaatggcccagggaaaacccaccttagacttcgagctcaccaagaccaccgccatggaggtggccctcctgcggacctactgcatcgaagcctccatcagcaacatcacgaccgcgacccgctgcccgacccagggggagccctacctcaaggaagaacaggaccagcagtacatctgccggcgcgatgtggtcgacaggggctggggcaacggatgcggtctcttcgggaagggcggcgtggtgacgtgcgccaagttctcctgcagcgagaagatcaccggaaacctcgtccagatcgagaaccttgaatacaccgtggtggtcactgtgcacaatggggacacacacgccgtcggcaatgacaccagcaaccacggcgtgaccgccaccatcacgccccgctccccctctgtggaggtcgagctgccggattacggtgagctgaccctcgactgcgagccccggagcggcatagacttcaacgagatgatcctgatgaagatgaagaagaagacctggctggttcacaagcagtggttcctcgacctgcccctgccctgggccgctggtgcggatacatccgaggttcactggaactacaaggaaaggatggtcaccttcaaggtgccgcacgcaaagcggcaggacgtgactgtcctcggcagccaggagggagctatgcacagcgccctggcgggagccaccgaggtggactccggcgacgggaaccatatgttcgccggccacttgaagtgcaaggtgagaatggagaagctccgcatcaaggggatgagctataccatgtgttccgggaagttctcaatcgacaaggagatggccgagacccagcacggcacgacagtcgtcaaggtgaagtacgaaggggccggcgcgccctgcaaggtcccgatcgagatccgggacgtgaacaaggagaaagtggtcgggagggtgatctccagcatccccctggctgaaaacaccaactccgtcacaaacattgagctggagccacccttcggcgactcgtacatcgtcatcggggtgggcaattccgccctcacgctgcattggttccgcaagggaagttccatcggaaagatgttcgagagcacataccggggcgccaaacgggtggcgatcctgggggagacagcctgggacttcggctccgtcggagggctcttcacgagcctcggtaaggcggtgcaccaggtgttcgggtccgtatacacgaccatgttcggcggggtgagctggatggtgcgcatcctgattggcctcctggtactttggatcggcaccaacagtcggaacacttcaatggccatgacgtgcatcgctgtgggcggcatcaccctgttcctcgggttcactgtgcaggcggacatgggctgcgtcgtgtcctggagcgggcgagagctgaagtgcggcagcgggattttcgtggtcgacaacgtacacacttggacggagcaatacaagttccagccggaatcccccgcccgactggcgtcggccatccttaatgcccataaggacggcgtatgcggcatacgctccaccacccggctggagaacgtcatgtggaagcagatcacaaacgagctgaattacgtgctctgggagggcgggcacgatttgacggtggtcgcgggggacgtgaagggcgtgctgaccaaggggaagcgcgccctgacccctcccgtgagcgacctgaaatactcatggaagacctgggggaaggccaaaatcttcacgcccgaagcccggaacagcacattcctgatcgacggccccgacacctccgaatgtccgaacgagcgccgggcttggaacagcctcgaggtcgaagactacgggttcggcatgttcactacaaacatatggatgaagttccgcgaggggtccagcgaggtctgcgaccatcggctgatgtccgccgccattaaggaccagaaggccgtccacgccgacatgggctactggatcgagtcgtccaagaaccagacctggcagatcgagaaagcgagcctgatcgaggtgaagacttgcttatggcccaagacccacacgctgtggtcaaacggcgtgctggaaagccagatgttaatccccaagtcgtacgccgggccgttcagccaacacaactaccggcagggctacgccacccagaccgtcgggccctggcacctgggcaagcttgagatcgacttcggcgaatgccccggcactaccgtcacgatccaggaggactgcgaccatcggggtcccagcctccgcacaaccacagcctccgggaaactggtcacgcagtggtgttgccgcagctgcacgatgccgcccctacgcttcctcggcgaggacggttgctggtacggcatggagatccgcccactgtccgagaaagaggagaatatggtcaaaagccaggtggccgcggggcagggaacctcagagaccttcagcatgggactgctctgcctgacactgttcgtagaggagtgccttcggagacgggtgacccgcaagcacatgatcctggctgtggtcatcaccctgtgcgccatcatcctcggtggcctgacctggatggaccttctccgggccctgataatgctgggggacacgatgagcggccgcatcggcgggcagactcacctcgcaatcatggctgttttcaagatgtcccccggctacgtcctgggggtcttcttacggaagctcacgtcccgtgagaccgccctgatggtgatcggcatggccatgacgacgaccctgagcatcccgcacgacctcatggagctgatcgacggcatttccctgggcctcattctgctgaagatcgtcacccagttcgacaacactcaggtgggcaccctcgctctgtccctgaccttcatccggtccacgatgagcttggtgatggcctggcggacgatcatggcggtgcttttcgtcgtgaccctgatccccctttgccggacctcctgcctacaaaagcagagccactgggtcgagattaccgcactgatcctcggggctcaggcattgcccgtctacctgatgacgttgatgaaaggagcgtcccgacggagctggccccttaacgaggggatcatggcagtgggcctcgtgtccctcctcgggtccgccctgcttaaaaacgacgtcccgctggccggcccaatggtggccggggggctcctcctggcggcctacgtgatgagcggctccagcgcggacctgtccctggagaaggcagccaacgttcagtgggacgaaatggctgacatcaccggttcctcacccatcatcgaggtgaagcaggacgaggacgggtctttctccatccgcgacgtcgaggagaccaacatgatcactctgctggtcaaactcgccctgatcacggtgagcggtctgtacccgctcgccatcccggtgaccatgaccctgtggtacatgtggcaggtcaaaacccaacgatccggcgccctgtgggacgttcccagcccagcggcgacgcagaaggccgccctcagcgagggcgtgtaccgcatcatgcagcgagggctgttcggcaagacccaggtcggggtgggcatccatatggagggcgtgttccataccatgtggcacgttacccgcggcagcgtgatctgccacgaaacaggccggcttgagccctcctgggccgacgtgcgcaacgacatgatcagctacgggggggggtggcgcctcggcgataagtgggacaaggaggaggatgtacaagtgctggccatagagccgggcaagaacccgaagcacgtgcagaccaaaccagggctgttcaagacattaaccggagagatcggggcggttaccctggacttcaagcccgggacgtccgggagcccgatcatcaaccggaagggcaaggttataggactgtacgggaacggcgtggtcaccaagtccggggactacgtcagcgccatcacccaggcggagcgcatcggcgagccggactacgaggtcgacgaggacatcttccggaaaaaacgcctcacaatcatggatctgcacccaggggccggcaagacgaaacggatcctgccttccatcgtccgcgaagcgctgaagcggcgcctccggaccctgatcctggcacccacccgcgtggttgccgcggaaatggaggaggcgctacggggcctgcccatcagataccagacccccgccgtcaagagcgagcacaccggacgggagattgtagacctgatgtgccacgccaccttcaccacccgcctcctgtcgtccaccagagtcccgaactacaacctgatagttatggacgaggcccacttcaccgaccccagctccgtggccgctagaggctacatcagcacccgggtcgaaatgggggaggcggccgcgatcttcatgactgccactccgcccggagccacagatccgttccctcagtccaacagccccatcgaggacatcgagcgcgagattccggagcggtcctggaacaccggcttcgactggattaccgattaccagggaaagacggtgtggttcgtgccgagcatcaaagcgggcaacgacatcgcgaactgtctccgcaagtccgggaagaaagtcattcagctgagccgcaagacattcgacaccgagtacccgaagaccaagctgacagactgggactttgtggtcaccacggacatctcggagatgggtgccaacttccgggccgggcgcgtcatcgacccgcggcgctgcctgaagcccgtgatcctgaccgacggcccggagagagtgatcctggccggacccatccccgtgacgcccgccagcgccgcacagagacggggccgcatcggccgcaatccggcccaggaggacgaccagtacgtgttttcaggggaccccctcaagaacgacgaggaccacgcgcactggaccgaggccaagatgcttctggacaacatctacacccccgagggcattatacccaccctcttcgggccggagcgcgagaaaacgcaggccatcgacggcgagttccggctgcgcggcgagcagcggaagaccttcgtggagctgatgcgccgcggggatcttcccgtctggctgagctataaggtggcgtccgccggcatcagctacaaggaccgtgaatggtgtttcactggggagcggaacaaccaaatcctggaggagaatatggaagtggagatctggacccgcgagggtgagaagaagaagctccggccccgctggcttgacgctcgcgtctacgccgaccctatggccctgaaggacttcaaggagttcgcatccggccgcaagtcgatcacgctcgatatcctgaccgagatcgcgagcctgcctacctatctcagcagccgtgcaaagctggccttggacaacatcgtgatgctccacacaaccgaacggggcggccgtgcttaccagcacgcccttaacgagctgcccgaatccctcgagaccctgatgctggtggcgttactaggagccatgacagcaggcatcttcctgttcttcatgcagggaaagggtattgggaaattgtcaatgggcctgatcaccatcgccgtcgcctccggcttgctctgggtggcggaaatccagccccaatggatcgccgcttcgattatcctggagttcttcctgatggttctcttgatccccgagccagagaagcagcggacgccccaggataaccaactgatctacgtcatcctcgccatcctgacgattatcgggctgatcgccgcgaacgagatgggcctcatcgagaaaacgaagaccgacttcgggttctaccaggtgaagaccgagacgaccatcctggacgtggatcttcgacccgcctccgcctggaccctctacgccgtcgccaccacgatccttactccgatgctgcggcacaccatcgaaaacaccagcgcgaacctctccctggcggccatagcaaaccaggccgcggtgctgatgggcctggggaagggatggcctcttcataggatggacttaggggttcccttgctggccatgggatgttatagccaggtcaaccccacgacactgaccgcctccctcgttatgcttctggtccactacgccatcatcggccctgggttacaggcgaaggccacaagggaggcccaaaaacgcacggccgccggaatcatgaaaaatcccaccgtggacggtatcaccgtaatcgacctggagcccatcagctacgaccccaagttcgagaagcaattaggccaggtgatgctcctggtcctgtgtgcgggccaactgcttctgatgcggaccacgtgggcattctgcgaggtactcacactcgccactgggccgatcctcaccctctgggaggggaaccccgggcgcttctggaatacaaccatcgctgtgtccaccgccaacatcttccggggcagctacctggcaggtgccgggcttgcctttagtctcatcaagaacgcccagacgccccggcggggcacggggaccaccggcgagaccctgggggagaagtggaagcgccagctgaacagcctcgaccggaaagagtttgaggagtacaagcgctccggcatcctggaggtcgaccggacggaggccaagagcgcgctgaaggacggctccaagatcaaacacgcagtgagccgcgggtccagtaagatccggtggattgtggagcgcggcatggtcaagcccaaggggaaggtggtggacctcggctgcgggcgcggcggatggagctactatatggccaccttgaagaacgtcacagaagtgaagggttacaccaagggcgggccggggcacgaagagcccatcccaatggctacctacgggtggaacctggtgaagctccactccggggtcgacgtgttctacaagcctacggagcaggtcgacaccctgctgtgcgacataggcgagtcctctagcaaccccaccatcgaagaggggcggacccttcgcgtcttgaagatggtggagccgtggctttccagtaagcccgaattttgcatcaaggtcctgaatccctacatgccgacggtgatcgaggagctcgagaaactccagaggaagcacggcgggaacctggttcgctgtcccttgtcccgcaacagcacccacgagatgtattgggtatccggcgcgtccggtaacatcgtgagttctgtgaacacgaccagcaagatgctgcttaacaggttcacgacccggcaccgcaagcccacctacgagaaggacgtcgacctcggggccgggacccggagcgtgtccacggagaccgagaagcccgacatgaccatcatcgggcgccggctgcagcgcctgcaggaagagcataaggaaacctggcattacgaccaagagaacccgtatcggacgtgggcctaccacggcagctacgaggccccctccaccggcagcgcctccagcatggtcaacggggttgtgaagctcctgaccaagccctgggatgtgatcccgatggtcacccagctggcgatgacggacaccaccccctttggacagcagcgcgtgttcaaggagaaggtggacacccggacgccccagcccaagccggggacccgcatggtcatgaccaccacggccaactggttatgggccctgctggggaagaagaagaacccccggctctgcacccgagaggagtttatcagcaaggtgaggagcaacgccgccatcggggctgtgttccaggaggagcagggctggaccagcgcctccgaggcggtcaacgacagccgcttctgggaactggttgacaaggagcgcgccctgcaccaggagggcaagtgtgaatcctgcgtgtacaacatgatgggcaagcgcgagaagaaactcggcgaattcgggcgcgcgaagggtagccgggccatctggtacatgtggctgggggcccgcttcctggaattcgaggcgttgggcttcctgaatgaggaccactggttcggacgggagaactcctggagcggcgtcgagggcgaggggctgcaccgcctaggctacattctggaggagatcgacaagaaggacggggaccttatgtacgccgacgacaccgcgggctgggacacgaggatcaccgaggacgacctccagaacgaggagctgattaccgagcagatggcgccgcaccacaagatcctggccaaggcaattttcaagctcacttaccagaacaaggtggtgaaggtcctgcgccccacgccgcgcggcgccgttatggacatcatatcacggaaggaccagagagggagcggccaggtcgggacatatgggctgaacacattcactaacatggaggtccaactcatccgccagatggaagcagagggggttataacccaggacgacatgcagaatccgaagggcctgaaggagcgggttgagaagtggctgcgcgagtgcggcgtcgaccggttaaaacgcatggccatctcgggggacgactgcgtcgtgaagcccctggacgagcggttcgggacgagtctcctgttcctgaacgacatggggaaggtccggaaggacatccctcagtgggagccgtccaagggctggaagaactggcaggaggtgccgttctgcagccaccacttccataagatcttcatgaaggatggtcggagtctggtggtcccctgccgcaaccaggacgagctcatcggcagggcccgcatcagccagggcgccgggtggtccctgcgcgagaccgcctgtctgggcaaggcgtacgcccaaatgtggtcgctcatgtatttccacaggcgcgatttgcggctggcgagcatggccatctgctccgccgtgcccaccgagtggttcccgacctcccgcacgacctggtccatccacgcacatcatcagtggatgactaccgaagacatgctaaaggtgtggaaccgggtatggatcgaggataaccccaatatgatcgacaagacgcccgtgcactcctgggaagacatcccttatctggggaagagggaagacctgtggtgtggctccctcattgggctgagctcacgagccacgtgggccaagaatatccacacggcaatcactcaagtgcgcaacctgatcggaaaggaggaatatgtcgattacatgcctgtgatgaagcggtacagcgccccttccgagagcgagggcgtcctctaa

SEQ ID NO: 26330 - RNA, 9867 nt, synthetic construct
  misc_feature 1..9867: note = derived and/or modified CDS sequence (opt11) from DENV-4__JQ513336__SS-prME
  source 1..9867: mol_type = other RNA
tccacaataacactcctttgcctcatacccacggtaatggctttccacctaagcacgcgggatggcgaaccactcatgatagttgctaaacacgaaagaggccgtcccctactcttcaaaaccacagaaggaatcaacaaatgtacactcatcgcgatggacctcggcgaaatgtgcgaagataccgtgacttacaaatgtccactactcgtgaacacggaacccgaagacatagactgctggtgcaacctcacctctacatgggtaatgtacgggacatgcacgcaatcaggtgaacggagaagagaaaaacgcagcgttgctctaacaccacacagcggaatgggactggaaacccgagctgaaacctggatgagctccgaaggtgcctggaaacacgcccaaagggtggagagctggattcttcgtaatccggggttcgctctcttggcggggttcatggcctacatgataggccaaaccggtatacagagaacagtcttctttgtgctaatgatgctggtagctccgagctacggcatgcgttgcgtgggagtcgggaaccgagacttcgtagaaggtgtttctggaggagcctgggtcgacctggtcctagaacacggaggctgcgttaccacgatggcgcagggaaaacccaccctcgacttcgaattgacaaaaaccacggcaaaagaggtagccctattaagaacctattgcatagaggcttcgatcagcaacatcacaactgccacaagatgcccaacacagggggagccgtacctcaaagaggagcaggaccaacaatacatatgtagaagagacgtggtagacaggggctgggggaacggctgtggactcttcggcaaagggggagtagtgacctgcgctaaattttcatgcagtgagaagataacgggaaacttagtccaaatcgaaaacttggaatacaccgtagtcgtaacggtacacaacggcgacacgcatgcggtgggtaacgatactagcaaccatggagtaacagcaacgataacgcccaggtccccaagtgtagaagtagagctgccggattacggcgagctaacgctcgactgcgaaccccgatccggtattgactttaacgaaatgatcctcatgaagatgaagaagaaaacgtggctggtccacaaacagtggttcctagatctaccgctgccatgggcggcaggcgccgacaccagtgaggtccactggaactacaaggaaaggatggtaacgtttaaggtcccccacgctaaacggcaggacgtcacggtgctaggtagtcaggaaggcgccatgcatagcgctctggccggagccacagaagtagatagcggggatggaaaccacatgtttgccggccatctcaaatgcaaggtacggatggagaagctgcgaatcaaggggatgagttacacgatgtgtagtggcaaattctccatcgacaaagaaatggccgaaactcagcacggaacgacggtagtcaaagtaaagtacgaaggggcgggcgcgccgtgcaaggtaccgatcgagatccgcgacgtaaacaaggagaaagttgtggggagggtaatatcatccatacctttggcagaaaacacaaactcagtcactaacatcgaactggaaccaccattcggggactcctatatcgtcatcggggttggaaacagcgcactaacactccactggttcagaaaagggagctctatcggaaagatgttcgagtcaacttatagaggagcaaagcgtatggcaatactaggagaaacagcctgggacttcggatcggtcggcggcctctttacttcgctagggaaagcggtgcaccaagttttcgggagcgtctacaccacaatgttcggaggtgtgagctggatggtccgaatactcataggcctgttggtactatggattggaaccaactcgcgtaatactagcatggcaatgacctgcatcgcggtaggaggaatcaccctattcctaggttttactgttcaggcggatatggggtgcgtagtaagttggagcggacgggagcttaagtgcgggagtggcatttttgtagtagataacgttcacacgtggactgagcagtacaaatttcaaccagaatccccagcgagactcgccagcgccatcctcaatgcgcacaaggacggagtatgcggtatccggagtacaactagacttgagaacgttatgtggaaacagatcactaacgaactgaactacgtactatgggaagggggtcacgacctgaccgtcgttgctggcgacgtcaaaggggtgctaaccaaaggaaaacgcgcgctcacgcccccggtgtcggacttaaaatattcctggaagacatggggaaaagcgaaaatatttacccctgaggcaagaaactccaccttccttatcgacggcccagacaccagtgaatgcccaaacgaacgccgtgcgtggaacagcctggaagtggaggattacgggttcgggatgtttactacaaatatctggatgaaattccgcgagggatcttccgaagtatgcgaccacaggttaatgagcgcggcaatcaaagaccagaaggcagtgcacgcagacatgggctattggattgaatcctccaaaaaccaaacgtggcaaatcgaaaaagcgagtttaatagaagtaaagacatgtctatggccgaaaacccacacattatggtcaaacggagtgctggaaagccagatgctaatacccaaaagctatgcgggcccattcagccagcataactatcgacaagggtatgccactcaaaccgtcggaccatggcacctgggcaagctagaaattgatttcggcgaatgcccagggaccactgtcacgatacaagaggactgcgatcaccgaggtccctcactacgcacgacaaccgcgtctggcaaacttgtcacgcagtggtgctgcaggtcttgcacaatgccacccctgaggttcttaggagaggatggttgttggtatggcatggagattagaccattaagcgaaaaggaggagaatatggtaaagtcacaagtagcggcgggccaagggacatcagagaccttttcaatgggactactatgccttacgctttttgtggaagagtgtctgcgacgcagagtcacacgcaaacacatgatactcgccgtcgtcatcaccctatgtgcaataatcctaggtgggttaacttggatggacttactacgcgcgctaatcatgcttggtgacacaatgagtggccgcatagggggccagacacacctcgcgataatggcggtcttcaaaatgagtcccggctacgtactcggggtcttcttaagaaagctaacctcaagagagacggccttgatggtcatcggcatggcaatgaccacgacactttcgataccccatgacctaatggagttaatagacggaatctctctcgggctaatcctactaaaaatagtgacccaattcgacaatacccaagtgggaacactagcactgtcacttacgttcatacgatccactatgtcactggtaatggcatggaggacaattatggccgtattattcgtagttacgctgatcccgctatgtagaacttcatgcttacaaaagcagtcccactgggtcgaaatcacagccctgatcctaggtgcacaagcgctaccagtatacctaatgaccctaatgaagggcgcgtcccgacgtagttggccacttaacgagggaataatggcggtcgggctggtgagcttgctggggagcgcactactaaagaacgacgtgccgctcgcgggccccatggtggccggcggactgctacttgccgcgtatgtaatgtcagggtcctcggcagacctctccctcgagaaagcggccaacgtacagtgggacgaaatggcagacataaccggttcgtcgccaataatagaagtgaagcaggacgaagacggatcgttctctatacgagacgtagaagagacgaatatgataaccctactcgtgaaattggcgttgataaccgtgagcggcctatacccgttggcgataccggtaacgatgacactatggtatatgtggcaagtcaagacccagagatcaggagccctatgggacgtaccatcaccagctgcgacgcagaaagcggcactatcagaaggcgtctacagaatcatgcagcgcggcctatttggaaaaactcaagtgggggtaggcatacatatggaaggtgtgttccataccatgtggcacgtaaccagaggcagcgtgatatgccacgagaccggacggctcgagccgagctgggccgatgtgagaaacgacatgatcagttacggcggaggatggcgcttgggagacaaatgggataaggaagaagacgtccaagtgctagcgatagaaccaggcaaaaacccgaaacacgtgcagaccaaaccgggccttttcaaaacccttaccggagagattggggcagtaaccttagacttcaaaccgggaacctcaggttccccaatcatcaaccgaaaaggcaaggtcatcggtctgtacggaaacggggtggtgacgaagtctggagactacgtcagcgcaatcacacaagcggaacgtataggggagccagactacgaggttgacgaagatatcttcaggaagaaaagacttacgataatggacctccatccgggcgcagggaagacaaagagaatattacctagtatcgtcagagaagcattaaaaaggcgactgcggacactgatactcgcgcccacacgtgtcgtggctgcagagatggaagaagcactccgaggtctcccaatacggtaccaaaccccggcggtaaaaagcgaacacaccggcagagaaatagtcgacctgatgtgtcatgcgaccttcaccacacggctcttgtcttccacaagggtaccaaactacaacctgatagtcatggacgaagcccactttacggaccccagttcagtggcggcaagaggatacatatcgactcgcgtagaaatgggagaggcagcggcaatattcatgaccgcaactccaccgggcgctacggaccccttcccccaaagcaattcaccaatagaagacatcgaacgagaaatccccgagcgaagctggaacaccggattcgattggattaccgactaccaggggaaaacagtttggttcgtcccaagcatcaaagcaggaaacgacatagccaactgtttgcggaaatcgggaaagaaggtgatacagctatcacgcaaaactttcgatactgagtatccgaaaaccaaactgaccgactgggacttcgtcgtgacaacagatatcagcgaaatgggtgcgaatttccgcgccggaagggtgatagacccgaggcgatgtttaaagccggtaatactaaccgatggcccggaacgggttattctagcaggcccaatacctgtaacgccagcgtccgcggcacagagaagaggccggattggccgtaacccagcacaggaggacgaccagtatgtctttagcggcgacccgctgaaaaacgatgaggatcacgcgcactggactgaagcaaaaatgctcctggacaacatatacacgcccgagggcataatccccacattattcggacccgaacgtgagaagacgcaagcgatcgacggcgagttccgactacgcggagagcagagaaaaaccttcgtcgaactcatgcgccgaggagaccttccagtgtggctgagttacaaagtcgcttccgccggcataagctacaaagatcgcgagtggtgtttcacaggcgagagaaacaatcaaatactcgaagagaacatggaagtagagatctggaccagagaaggagagaagaagaaactaagaccccgatggttagacgcaagggtatacgctgacccaatggccctgaaggacttcaaagagtttgcatcagggagaaagtcgataacactagacatattgacggagatagcctcactcccgacatacttatcatcacgagcaaaactagcgctggacaacatcgttatgttacacacaactgagagaggcgggcgggcataccagcacgcgctcaatgagctcccagaatccctagaaaccctaatgctggtagcacttctgggggcgatgacagcgggcatctttctattctttatgcaaggaaagggaataggtaaactcagtatggggctcatcactatagcggtggccagcggactactttgggtcgctgaaattcaaccgcaatggatagcggcgagtataatattagagttcttcctcatggtactattgatacccgaacccgagaaacaacgaacaccacaggacaaccagctaatctatgtgatcctggcaatacttactatcatcggattaatagcagcaaacgagatgggcttaatagaaaagactaaaaccgactttggtttctaccaggtgaagaccgaaaccacaatactcgatgtagacctacgtccggcatcggcatggaccctgtacgccgtagccacgactatcctgactcccatgctgcgtcacaccatagaaaacacaagcgcgaacttatcccttgcagccatcgccaatcaggctgcagtcctaatgggtcttgggaaagggtggccgttacaccggatggacttaggagtgccattactcgcaatgggatgttactcacaagtgaatccaacaaccttaaccgcaagtcttgtcatgttacttgtacattatgcaataataggccccggattacaagcaaaggcaaccagagaagctcaaaagcgcacagccgccggcataatgaagaaccccacagtagacggtatcacagtcattgacctagagccgatttcgtatgacccaaagttcgagaagcaactaggacaggttatgctactggttctgtgcgcgggacagctcctgttaatgagaacgacgtgggctttctgcgaggtactgacattggccactgggccgatactgacgctatgggaggggaatcccggacgcttctggaacacaacaatagcagtatcgaccgcaaacatattcagggggagttacctagcaggagccgggctcgctttcagcctcatcaaaaatgcgcaaaccccaagacggggaactggaaccacgggagaaacactgggggaaaaatggaagcgacaactcaacagtctagaccggaaggaatttgaagaatacaaaaggtcgggcatactcgaggtagaccgcacggaggcgaagtccgccctgaaagacggatccaagatcaaacacgccgtatcccgaggatccagtaagatccgctggatagtagaacgagggatggtgaagcccaaaggaaaagtggtggatctaggctgcggtcgtggaggatggtcatactacatggcaacactcaagaacgtaaccgaagtgaaagggtacacaaaaggtggaccaggacacgaagaaccaataccgatggcgacatacggatggaacctcgtaaaactacactcaggggtagatgtgttttataaacccactgaacaagttgacactctgctgtgcgatatcggcgagtccagcagcaatccgacgatagaggaaggtaggacactaagggtactaaaaatggtagaaccgtggctcagttcaaagccggaattttgtataaaggttctcaacccgtacatgccgaccgtaatagaagaactcgaaaagctccaaagaaaacatggcgggaacctagtgcgttgccccctctcgcgaaactctacacacgaaatgtattgggtcagtggcgccagcggaaacatagtcagctccgtaaacacgacatcaaagatgctcctgaaccggttcaccacgaggcataggaaacctacatacgagaaagatgtagacctcggtgcagggacccggtcagtgagcacagaaacggaaaagccggacatgacaataataggtcggcgactgcaacgactccaagaagaacacaaggaaacctggcactatgatcaggagaacccctacagaacatgggcttaccacggctcatacgaggcaccaagcaccggaagcgcatcgtccatggtcaacggagtagtaaaactcctaaccaaaccttgggacgtaatacctatggtgacacagctagcaatgaccgatactacaccgttcgggcaacaacgcgtcttcaaggaaaaagttgacacacgcaccccacaaccgaagccgggaaccaggatggtgatgacgaccacggcaaactggctctgggcattactggggaagaagaaaaacccgaggttatgcacacgcgaggaatttattagcaaagtgaggtccaatgcggcaattggagcggtcttccaagaagaacagggatggacgagtgcttcagaggcagtaaacgattcccgattttgggagctggtagacaaagagcgcgcgctacaccaggagggcaaatgcgaaagctgtgtatacaacatgatgggcaaaagagagaagaaactcggtgagtttgggcgggccaaagggagccgcgctatatggtatatgtggctaggcgcacgcttcttagagttcgaggcgctagggttcttaaatgaagaccactggttcggccgcgagaacagttggagcggggtggaaggcgagggtctgcaccgtctaggctacatattggaagagatagacaagaaagacggagacctcatgtatgcggacgacactgccggatgggacacccgcattacggaagacgacctccaaaacgaagaactgataaccgaacaaatggcaccacaccataaaatcctagccaaagcaattttcaaattaacataccagaacaaagttgtcaaggtgctgagaccgacaccccggggagccgtaatggatataatcagtcgaaaagaccaacgcggctcggggcaggtaggtacctacgggttgaacacctttacgaatatggaggtccagctgatccgccaaatggaagccgaaggggtaataacacaggatgacatgcaaaacccaaaaggactcaaggagcgagtcgaaaagtggcttcgagaatgcggagtggacagactgaagcggatggcgattagcggagacgactgcgtagtgaaaccactcgatgaaaggttcggaacctccctcctatttctgaatgacatgggcaaggttaggaaagatatcccgcagtgggaaccatcaaaagggtggaaaaactggcaagaagtaccgttctgttcccaccatttccataaaatctttatgaaagatggccgctcgctcgtcgtaccatgcaggaatcaagacgagttaatcgggagagccaggatcagccaaggcgcagggtggagcctgagggagacggcctgcctggggaaggcttacgcgcaaatgtggagtctaatgtatttccatagaagagacctgcgactagcaagcatggctatatgttcggctgtcccgaccgaatggttcccaacctcgagaaccacctggtccatacacgcgcaccaccaatggatgaccaccgaggatatgctcaaggtatggaaccgagtctggattgaagacaaccctaatatgattgacaagacacccgtgcactcatgggaggacatcccatacctcgggaagagagaggatctatggtgcgggtcattaatcggcttaagcagccgagcgacatgggcaaagaacatacacacagcaataacgcaagttcgaaatcttatcggcaaagaagaatacgtcgactacatgccggtcatgaaacgttactcggctccatccgaatccgaaggagtcctataa

SEQ ID NO: 26331 - RNA, 9867 nt, synthetic construct
  misc_feature 1..9867: note = derived and/or modified CDS sequence (opt11) from DENV-4__JQ513338__SS-prME
  source 1..9867: mol_type = other RNA
agcacgattaccctgctctgcctgatccccacggtgatggcgttccacctgtccacacgggatggcgagcccctcatgatagtggccaagcacgagcgggggcgacccctgcttttcaagactaccgagggcatcaacaagtgcacgctaatcgcgatggacctgggggagatgtgcgaggataccgtgacctacaagtgtcccctgctcgtgaacaccgagcctgaggacatcgactgttggtgcaacctgacgtccacctgggtaatgtacgggacatgcacccagagtggggagcggcgcagagagaagcgaagcgtggccttgacgccccacagcggaatgggcctcgagacgcgggccgagacctggatgtcctccgaaggcgcatggaagcacgcccagcgcgtggagagttggattctccgaaaccccggcttcgcactgctcgccgggttcatggcgtacatgatcggccagacaggtatccaacggaccgtattcttcgtgctgatgatgctggtggcaccctcctacggcatgcggtgcgtcggcgtgggtaaccgcgacttcgtggagggggtcagcgggggcgcgtgggtggacctcgtgctggagcacggcgggtgtgtgacgaccatggcccagggcaagcccaccctggacttcgagctaactaagaccaccgcgaaggaggtggccctgctgcgtacctactgcatcgaggccttaatctccaacatcacgaccgctacccgttgcccaacacagggggagccctacctaaaggaggagcaagagcagcagtacatctgccggcgcgacgtggttgaccgtggctgggggaacggctgtggcctgttcgggaagggcggggttgtgacctgcgccaagttctcatgctccggcaagataaccggaaacctcgtccaaattgagaacctggagtacaccgtggtggtcaccgtacacaacggcaacacgcccgcagtcggcaacgacacctcgaatcacggggtgacagcccccatcacgccgcgctcccccagcgtggaggtcaagctgcccgactacggcgaactcactttggactgcgaaccccggagcgggatcgacttcaacgagatgatcctcatgaagatgaaaaagaagacttggctcgtgcacaagcaatggttcctggacctgccgctaccctggaccaccggtgccgacaccagcgaggtgcactggaattacaaggagagaatggtaacgttcaaggtaccccatgcgaagcggcaagacgttaccgtgctgggtagccaggagggcgccatgcacagcgctctggccggcgccactgaagtggacagcggagacgagaaccacatgtttgcgggccacctcaagtgcaaggtgcgcatggggaagctgcgcatcaagggtatgtcctacaccatgtgtagcggcaagttctctatcgacaaggagatggccgagacccagcatgggaccaccgtcgtaaaggtaaagtatgagggggccggggcaccatgcaaggtcccgattgaaatacgggatgtgaataaggaaaaggtggtcggccgcgtcatctcggcaactcccctggcagagaacacgaactccgtaactaacattgagctcgagccgcccttcggagaccgctatatcgtcatcggcgttggcaatagcgccctgaccctgcattggttccgcaaaggatccagcatcggcaagatgttcgagtccacctaccgcggcgccaagcgcatggccatcctcggcgagaccgcgtgggactttgggagcgtgggtggcctcttcacttctctggggaaggccgtccaccaagtgttcggttctgtatacacaaccatgttcggcggcgtgtcgtggatgatccggatccttatcgggttcctggtgctgtggatcggcacaaactcacgcaacacctccatggccatgacctgcatcgccgtaggtgggataaccctgttcctcggcttcacggtccaggccgacatgggctgcgtggtgagctggtccggtcgggagctgaagtgtgggagcggcatcttcgtagtagacaatgttcacacctggacagagcagtacaagttccagccggagagtcccgcaagactggccagtgccatcctcaacgcccacaaagacggcgtctgcggaatccggagcaccacgcgcctggagaacgtgatgtggaagcagattaccaacgagctgaactacgtgctctgggagggcggacatgaccttaccgtcgtggccggtgacgtgaaaggcgtgctgaccaagggaaagcgggcgctgaccccgcccgcctccgatctaaagtacagctggaagacctggggcaaagctaaaatcttcacaccggaggcccggaattccaccttcttaatcgacggtcctgacacgagcgagtgccctaatgaacgccgcgcctggaacagcttcgaggtggaagattatggcttcggaatgtttaccaccaacatctggatgaagttccgagagggcagctccgaggtttgcgatcaccgcctcatgagcgcagccatcaaggaccaaaaggctgtacacgcggatatgggctattggatcgagagtagtaagaaccagacgtggcagatcgagcgggcttccctcatcgaggtgaagacgtgtttgtggcctaagacacacaccctctggagcaacggggtgctggagagccagatgctgatcccgaagagctacgccggacccttttcccaacacaactaccgccaagggtatgccacccagacagtcggcccctggcacctcggaaagctggagatcgatttcggcgagtgcccgggcacaaccgtgaccatccaggagaattgtgatcaccgcgggcccagcctgcggaccacgaccgcgtccggcaaactcgtgacccaatggtgctgtcgctcctgcaccatgccgccactgcggttcctgggggaggacggctgctggtacgggatggagatccgcccactctcggagaaagaggagaacatggtcaagtctcaagtgacggccggccagggcacctctgagacattttccatgggcctgctgtgcttgaccctgttcgtcgaggaatgcctacgacgccgggtgacgcgaaagcacatgatcctcgctgttgtcattaccctgtgtgccatcattctaggagggctcacatggatggacctgctgcgggctctcatcatgctgggcgatacgatgagcggccgcataggtggccagacgcacctggccatcatggccgtattcaagatgtcccccgggtacgtgctaggcgtcttcctgagaaagctgactagccgtgagactgcgctcatggtaatcgggatggccatgaccaccacactgtccatcccccacgacctgatggaactcatagacggcataagcctgggcctcatcctcctgaagatcgtgacccagttcgataacacccaagtaggcacactggccctctccctgacattcattcgcagcaccatgtccttagtgatggcctggcgaacaataatggctgttcttttcgtggtgacgctaataccgctttgccggacaagctgcctccagaaacagtcgcactgggtagagatcaccgcactgatactcggcgcccaggccctcccagtttacctgatgactctgatgaagggtgcctctcgccggtcctggcctctcaacgagggcattatggccgtgggtttagtgtcgctgctggggtccgccctgcttaagaatgacgttcctctcgccggcccaatggtggccgggggcttacttctcgccgcatacgtgatgagcggatctagcgccgacttgagcctggagaaggccgcgaacgtccagtgggacgagatggccgacatcacgggctcctcaccgatcatcgaggtgaagcaggacgaagatggatcgttcagcatccgcgatgtggaagagaccaacatgatcacactcttagtaaaactggccctcatcaccgtgagtgggctgtacccacttgccatccccatcacaatgacactctggtacatgtggcaagtcaagacccagcggagcggcgccctgtgggacgtaccctccccggccgcgacccagaaggcggccctgtcagagggcgtgtaccgcatcatgcagaggggcttattcgggaagacacaggtgggagtcgggatccatatggagggcgtgttccacacgatgtggcacgttaccaggggcagcgtgatctgccacgagaccggccgcctggagccctcgtgggccgacgtgcggaacgacatgatttcttacggagggggttggcgcctgggcgacaagtgggacaaggaggaggacgtgcaagttttggccatcgaaccagggaagaaccctaaacacgtgcagaccaagccaggcctcttcaagacgctgaccggggagataggcgccgtgacgctcgacttcaagcctggcaccagcggttcccccataatcaacaggaagggcaaggtcatcgggctgtacggcaacggggtggtcaccaagagcggcgactacgtctccgcgatcacccaggccgagcgcatcggtgaaccggactacgaggtggacgaagacatcttccggaagaagcgtctgaccataatggaccttcaccccggcgccggcaagactaagcggatactgcccagcatcgtgcgcgaagccctgaagcggcgcctgcggacgctcatcttggcgcctacccgggtcgtggccgctgagatggaggaggctctgcgggggcttcccatccgctaccaaacccccgctgtgaagtctgagcataccggccgggagatcgttgatctgatgtgccacgcgacgttcactacccgcctgttgagctccacgcgggtgcccaattacaacctgattgtcatggacgaggcccactttaccgaccccagcagcgtcgccgcccgcgggtatatctccactcgggtggagatgggcgaagcagcggccatcttcatgaccgccaccccgccgggtgccacggaccccttcccccagagcaatagtcctatcgaagacatcgagcgcgagatacccgagcgctcatggaacactggctttgactggatcaccgactaccagggcaagaccgtctggttcgtgccatcaatcaaggccgggaacgacatagcgaactgcctgagaaagagcggcaaaaaggtaattcagctctcccgcaagactttcgatacggagtaccccaagaccaagctgaccgactgggactttgtggtgacgaccgacatcagtgagatgggcgcgaacttccgggccgggcgcgttatcgacccgcggaggtgcctgaagccggtcatcctaaccgacgggccagagcgggttatcttagccggcccaattccggtgacccccgcttccgccgcccagcgccggggccgcatcggtcggaacccggcacaggaggacgatcagtatgtcttcagcggggaccccctgaagaacgatgaagaccacgcacactggacggaggcgaagatgctcttagacaacatctatacccctgaagggatcatacccacccttttcggtcccgagcgcgagaaaacccaggcaatcgatggagagttccgactccgcggggagcagaggaagacgttcgtagagctgatgcgccggggggacctgcccgtatggctctcctacaaggtagcatctgccgggatctcctacaaggatcgtgagtggtgcttcaccggtgagcgtaacaatcaaatcctggaggaaaacatggaagtggaaatctggacccgcgagggcgagaagaagaaactccggcctaagtggttggacgcccgcgtgtacgcggaccctatggccctgaaggactttaaggaattcgctagcggccgcaagtccataaccctagacatcctcaccgagatcgccagcctgccaacttatctgtcgtcgcgcgcgaagctcgcacttgacaacatagtcatgctgcataccaccgagcgcggagggcgagcctaccagcacgccctcaacgaactgcccgagagcctggaaaccctcatgctggtggccctgctcggcgcgatgacggccgggattttcctcttcttcatgcagggcaaaggaatcggaaagctgagcatgggcttaatcaccatagccgtggctagcgggctgctttgggtcgcggagatccagccccagtggatcgcggcctccatcatattggaattcttcctgatggtgctgctaatccctgaaccggagaagcagcgtaccccgcaggacaaccagttaatctacgtgatccttaccatcctcacgattatcggccttatagccgcgaatgagatggggctgattgagaagaccaagaccgacttcggcttctaccaggtcaagaccgagacaaccatcttggacgtggacctgaggcccgccagcgcctggaccttatacgcggtggccacgacaatcctcacccccatgctgcgccacacgatcgagaacacctccgctaacctgagtctcgccgcgattgccaaccaggccgccgtcctgatgggactcgggaagggctggccccttcaccggatggacctgggggttccgctgctcgccatgggctgctactcccaggtgaatcccacgaccctgaccgccagcctggttatgttgcttgtgcactacgccatcatagggcccggcctgcaagccaaggctacccgcgaggcgcagaagcggacggccgccggcataatgaagaacccaactgttgatggcatcaccgtaatagacctcgagccgatctcctacgatcctaagtttgaaaagcaactggggcaagtgatgctgctcgttttatgcgccggtcagctgctcctgatgcgcactacgtgggccttctgcgaggtgctgaccttggcgaccggccccatcctaaccctttgggagggtaaccccggccggttctggaatacgaccattgctgtgagcacagcgaatatcttcaggggatcctacctcgccggggccggcctggcgttcagcctcataaagaacgctcagaccccacggcgcgggacgggtaccaccggagagaccttaggagagaagtggaagcggcaattgaactccctcgaccgcaaagagttcgaggagtacaaacgtagcggcatcctcgaagtggaccgcaccgaggccaaatccgccctgaaagatgggtctaagatcaagcatgccgtctccagaggctcatccaagatcagatggatcgtggagcgcggtatggtgaagcccaagggcaaggtcatcgaccttgggtgcggcagaggcggttggagctactacatggcgactctcaagaacgtgacggaggtgaaaggatatacaaagggcggccccgggcacgaggagcccattccgatggccacctacggatggaacctggtaaagctgcactccggcgtggacgtcttctacaagcccacggagcaggtcgataccctcctgtgcgacatcggggagagtagcagtaaccccaccatagaggagggccgcacgctccgggtgctgaagatggtggagccctggctgagctcaaagcctgagttttgcattaaggtcctgaacccctacatgccaacggtgatagaggagctggagaaactccaacgcaagcatggtggcaacctggtccggtgtcccctgtcccgtaactcgactcacgagatgtactgggtcagcggcgcgagtgggaacatcgtcagctccgtcaacaccaccagcaagatgttactaaaccgcttcacgacccgccaccggaagcccacgtacgaaaaagacgtggatctgggcgcggggacccgctccgtgagcacggagaccgagaagcctgatatgaccataattggccgccgcctccagcgcctccaggaggagcacaaggagacctggcactacgaccaagaaaacccctatcgcacgtgggcttaccacgggtcctacgaggccccgagcaccggctccgccagctccatggtcaacggcgttgtgaaattactcacgaagccctgggacgttatccccatggtgacgcagctggccatgacagacaccaccccattcgggcagcaacgtgttttcaaggagaaagtcgatacccggacaccgcaaccaaagcccggcacgaggatggtgatgaccacgacggccaactggctctgggctttgctagggaagaagaagaacccgcgcctgtgcacccgggaggaattcatcagcaaagtgcgctccaacgcggccattggcgctgtcttccaggaggagcagggttggactagcgccagcgaggctgttaacgattcacggttttgggagctcgtagacaaggagcgcgccctgcaccaggagggaaagtgcgagagttgtgtctacaacatgatgggcaagcgcgagaagaagctgggggagttcggccgggcaaagggatccagggcaatctggtacatgtggctcggtgcgcggttcctggagttcgaggcgctggggtttctcaacgaggaccactggtttggccgcgaaaacagctggtccggcgtggagggggagggcctgcaccgtctggggtacattctcgaagagatcgacaaaaaggacggcgacctgatgtacgcggacgacacagccggctgggacacgcgcatcacagaggacgacctgcaaaacgaggagctcatcaccgagcagatggccccgcaccacaagatcctagcgaaggccatcttcaagctgacctaccagaataaggtggtcaaggtgctccggcctacaccccgcggggccgtaatggatatcatcagccggaaggaccagcgcggttccgggcaggtcggcacgtacgggttaaacaccttcaccaacatggaggtccagttgatccggcagatggaggccgagggcgtgatcacccaggacgacatgcagaacccgaagggcctcaaggagcgcgtggaaaagtggctgagggagtgcggggtggaccgcctaaaacggatggccatcagcggcgacgactgtgtggtcaagccgctcgatgagagattcgggacgtccctgttattcttaaatgacatgggcaaggtgcggaaggacatccctcagtgggagccctcgaaggggtggaagaactggcaggaggtgcccttttgtagccaccactttcacaagatcttcatgaaggacggccgcagcctggtcgtgccgtgccggaaccaggacgagctgatcggtcgggcccgcatatcccagggggccgggtggagcttgcgggagaccgcctgcctgggaaaggcttacgcccagatgtggtccctgatgtacttccatcgccgtgacctcagactggccagcatggccatttgctccgccgtgcccaccgagtggtttcccaccagccggaccacttggagcatacatgcccaccaccagtggatgacaacggaggacatgctaaaagtctggaaccgcgtctggatcgaggacaaccccaacatgatagataagacgcccgttcactcctgggaggacatcccctacctcggcaagcgggaggacctatggtgtggaagcctgataggcctttccagccgcgccacctgggcgaagaacatacatacagcaatcacccaggtccggaacctgatcggcaaagaagagtacgtggattacatgcccgtgatgaagcgctattccgcccccagcgagtccgaaggggtgctgtag

SEQ ID NO: 26332 - RNA, 9867 nt, synthetic construct
  misc_feature 1..9867: note = derived and/or modified CDS sequence (opt11) from DENV-4__JQ513339__SS-prME
  source 1..9867: mol_type = other RNA
tcaaccatcactctgctttgtctgatccccacggtcatggcctttcacctgtccacccgggatggcgaaccgctcatgatcgtcgccaagcacgagcgggggcgacccctgctgttcaagacaacagaaggaataaacaaatgcacgctcatcgcaatggacctgggggaaatgtgcgaggacaccgtgacttacaagtgccctttattggtgaataccgagcccgaggacatcgactgctggtgtaacctaaccagcacctgggtcatgtacggcacctgcacccagtctggggagcgtcgccgtgagaagcgaagtgttgccctgaccccgcactccggtatgggtctcgaaacccgggccgaaacatggatgagcagcgagggggcctggaagcacgcccaacgcgtagagagctggatcctacggaaccccgggtttgcgctgctcgcggggttcatggcctacatgatcggccaaaccgggatccagcgcacggtcttcttcgtgctaatgatgctagtggccccctcgtacggcatgaggtgcgtaggtgtggggaaccgcgacttcgtggagggcgtaagcggcggcgcgtgggtggacctcgtgctggagcatggcggctgtgtcaccacgatggcccagggcaagcccaccctggactttgagctcacgaagaccaccgccaaggaggtagctctgctgcggacctactgtattgaagccctcatctccaacatcaccaccgccaccagatgcccaacccagggtgagccgtacctaaaggaagagcaggaccagcagtacatctgtcggcgcgatgtcgtcgatcgaggctgggggaacggctgcgggttgttcgggaaagggggtgttgtcacgtgcgccaaattcagttgctcgggaaagataaccgggaacctcgtccagatcgaaaacctggaatacacagtagttgtcacagtgcataacggcgatacacatgctgtcggaaacgacacctccaaccacggcgttactgctaccatcacgccccgctccccaagcgtggaggtcaaactgccggactatggcgaactcactctggactgcgagcctcggtctgggatagacttcaatgagatgatactgatgaagatgaagaagaagacgtggctcgtccacaagcagtggttcctagaccttcctctgccttggaccaccggggccgacacgagcgaggtgcattggaactacaaggagcggatggcgactttcaaagttccgcacgcaaaaaggcaggacgttaccctgcttggttcccaagaaggagccatgcatagcgccctcgccggtgcgaccgaggtggatagcggggacgagaaccacatgttcgcagggcatctgaaatgcaaggtccgcatgggaaagctgcgcatcaaaggcatgtcttacacaatgtgcagcggtaagttttcaatagacaaggagatggcggaaacccagcacgggaccaccgtggtgaaggtcaagtatgagggcgcaggcgccccctgcaaagtgcccatcgagatccgggacgttaacaaggagaaggtcgtgggccgcgttttgagcgcgacgcccctggcagagaataccaactctgtaaccaacatcgagctggagccaccgttcggtgacagctacatcgtgatcggggtgggaaactccgctctcacgctgcattggttcactaagggttcaagcatcggcaagatgtttgaatcgacctacaggggggccaagcgcatggcgatcctgggcgagaccgcatgggacttcgggtcggtcggcggcctattcaccagcctgggcaaagccgtccaccaggtgttcggctccgtatacacgaccatgttcgggggcgtgagctggatgatccgaatcctgatcgggtttctcgtgctctggatagggacgaactcccgtaacactagcatggctatgacgtgtatagcagtaggcggcattaccctgttcctagggttcacagttcaggcagatatggggtgcgtggtctcctggagcggccgggagctcaagtgcgggtccggcatcttcgtcgtggataacgtccacacctggacggaacagtacaaatttcagcccgagagcccggcccgcctggccagcgccatactgaacgcacacaaggatggcgtgtgcgggattcggtccaccacccgcctcgagaacgtgatgtggaagcaaatcacaaacgagttaaactacgttctgtgggagggtggccacgacctcaccgttgtggcaggcgacgtcaagggcgtgctaacaaaggggaaacgggccctgaccccgccggcctcagacctaaagtactcctggaaaacctggggaaaagccaaaatctttacgcccgaggcccgcaacagcacattcctaattgacgggccggacacctccgaatgcccgaacgaacgtcgcgcttggaatagcttcgaggtggaggactacggcttcgggatgttcaccacgaacatctggatgaaatttagggagggttccagcgaggtctgcgaccaccgcctgatgtctgccgccatcaaagaccaaaaggccgtgcacgcggatatgggttactggatcgaaagctcaaagaaccagacctggcagatcgagcgggcctcactcatcgaggtcaagacctgcttgtggcccaagacccacaccctttggtccaatggtgtcttggaatcacaaatgctgatcccgaagtcctacgcaggcccgttctcacagcacaactatcgccaggggtacgccacgcagaccgtgggcccttggcatcttggcaaacttgagatagactttggagagtgccccggcacaaccgtaaccatacaggagaattgtgaccacaggggcccctccctgcgaacgacgacggcgtctggcaagctggtcacgcagtggtgttgccgcagctgcaccatgccgcccctccggtttctcggggaggacggctgctggtacgggatggagatcagacccctgtcagagaaggaggaaaatatggtcaaatcccaagtgaccgctggccaaggcacgtcagagacgtttagcatggggctcctgtgcctgaccctcttcgtagaagagtgcttgcggcgccgggtcacccgaaagcatatgattctggctgtggtgattaccctatgcgccataattctaggcggactcacgtggatggacctccttcgggcactaatcatgttaggtgacacgatgtctggccgcatcgggggccagacccacctggccattatggccgtctttaagatgagcccggggtacgttctgggcgtattcttacgcaagctaacatcccgcgaaacggccctgatggtgatagggatggctatgaccaccactctgagcatccctcacgatctgatggagttgatagacggcatctccctggggctaatcctgcttaagatcgtaacgcagttcgacaacacccaggttgggaccctggccctgagtctcacgtttatccggtctacaatgagcttagtgatggcctggcgaaccatcatggccgtactgttcgtggtgaccctcattcccctttgccgaacatcctgcctgcagaagcagtcacactgggtcgagataacggccctcatcctgggcgcacaggccctgcccgtgtacctcatgaccctgatgaaaggggcttcccgcaggagctggccactaaacgagggtataatggccgtggggctcgtctctctgcttggctcggccctcttgaagaacgacgtgccgctagccggccccatggtggcagggggcctcctgctggcggcctacgtcatgtccgggagcagcgccgatttgtccttagagaaggccgccaacgtacaatgggacgaaatggcggatatcaccggtagctcgcccattatcgaggttaagcaagacgaggacgggagcttctcaattcgtgacgtcgaggagacaaacatgattacactactcgtgaagctggcgctgatcaccgtatccggtctctaccccctggccatcccgatcacgatgaccctatggtacatgtggcaggtcaagactcagcggtccggagccctctgggacgtccccagccccgccgcgacgcagaaggccgccctatcagagggggtttaccgcataatgcaacggggcctgtttgggaagacccaggtgggtgtggggatccacatggagggggtcttccacacgatgtggcacgtcacccgcggctcggtgatctgtcacgaaacgggccggctcgagccttcctgggcagatgtgcgcaatgacatgataagctacggcggggggtggcgcctaggagacaagtgggataaggaggaagacgtccaggtgctagccatcgagcctgggaagaatcccaagcacgtgcagaccaaaccaggcttgttcaagactctgaccggggaaatcggcgcggttacgctggactttaagccagggacctctggcagcccgatcattaaccggaagggcaaggtgatcgggctctacggcaacggggtggtcaccaagtctggcgactacgtgtcggcaattacgcaggctgagcggataggtgagccggactacgaggtggatgaggacatctttcggaagaagagacttacaatcatggacctgcaccccggcgccggcaagacgaagcggatcctaccgtccatcgttcgcgaagctctgaagcggcgcttgagaacgctgatcctcgcccccacccgcgtagtggctgcagaaatggaagaggccttgcgtgggctgcccatccgctaccagacccccgcggtcaaaagcgagcatacaggccgggagattgtggacctcatgtgccacgccaccttcaccacccgcctgttatcctccacacgggtgccgaactacaatctcatcgtcatggacgaggcccattttacggaccccagctctgtggccgcccgcgggtatatctcaactcgggtggagatgggagaggcggccgccatattcatgacggccacacctccgggggccaccgacccgttcccccagtcaaacagccccatagaggacatcgagcgcgagattcccgagaggtcatggaatacgggcttcgactggatcacggactaccagggaaagaccgtctggttcgtgccgagcataaaggctgggaacgacatcgccaactgcctgcgcaaatccggcaaaaaggtcatccagctgagcagaaagaccttcgacaccgagtaccccaaaactaaactcaccgactgggattttgtcgttactactgacatctctgagatgggggccaacttccgggccggccgcgtgatcgacccccgtcggtgcctgaagcccgtaatcctgacggacgggcccgagcgggtcatactggcgggcccaatccctgtcacccccgccagcgccgcgcagaggagaggccgcatagggagaaatccggctcaagaggacgaccagtacgtgttttccggagaccccctgaagaatgacgaggatcacgcacattggaccgaggcgaaaatgctgctcgacaacatttacacccccgaggggatcatcccgacgttgttcggacctgagcgcgagaagacacaggccattgacggggagttccggcttcgcggggaacagagaaaaacgttcgtcgaactcatgcgcaggggcgacctgcctgtatggctgagctacaaggtggccagcgccggaatctcatacaaagaccgcgaatggtgtttcactggcgagcgtaacaaccagattctcgaggaaaacatggaagttgaaatatggactagggagggggagaagaagaagctgcgacccaagtggctagacgcgcgcgtgtacgctgaccccatggccttgaaagacttcaaagagttcgcgtccggccggaaaagcatcacacttgatatcttgactgagatcgccagtctcccaacctatctgagttcccgggcaaaactcgccctagacaacatcgtgatgctgcataccacggagaggggggggcgggcctaccagcacgccctcaacgagctccccgagagcctggagacgctgatgctagtggctctactgggcgccatgacagccggaatcttcttattcttcatgcagggtaaaggaatcggcaagctgagcatgggtctgatcaccatcgccgttgcctcggggctcctgtgggtggctgagatccagccccaatggatcgccgcctctattattctggagttctttctcatggtgctgctgatccctgagcccgaaaagcagcgcacgcctcaggacaaccaacttatctacgtcatcctgaccattctaacgatcatcggcctcattgccgccaatgagatgggcctcatcgagaagacgaagacggacttcgggttttaccaggtgaaaacggaaacgactattctggacgtggatctccggcccgcctcggcgtggactctatatgcagtggccaccaccatcctgaccccgatgctccgccacactatcgagaacacatccgccaacctatccctcgccgctatcgccaaccaggccgcggtgttaatggggcttggaaaggggtggcctctgcaccggatggacctcggggtccccctgctcgcgatgggctgttacagccaggtcaaccccactaccctcacggcttccttggtgatgttactggtgcattatgcaatcatagggccaggattgcaagccaaggcgacccgcgaagctcagaagcggaccgccgccggcatcatgaaaaatccaaccgttgacggcatcacagtgatagacctggagccgatcagctacgatcccaagttcgagaagcagctcggacaggtcatgctgttggttctatgtgcagggcaactgctgttaatgagaaccacgtgggcattctgcgaagtgctaactctggccacgggccccatcctaaccctttgggaggggaaccccggtagattttggaacaccaccatcgccgttagtacggcaaacatcttccggggcagctacctggccggtgcgggcctcgctttcagtctgatcaagaacgcccagactccccggcgggggaccggcaccactggcgagacgcttggcgagaagtggaaacggcagttgaacagtctggaccgcaaggaatttgaagaatataagcgctccggtatcctcgaggtcgaccgcaccgaggctaagagtgccctcaaggatggctcgaaaatcaagcatgcggtgtctcgtggctcctcgaaaatacgctggatcgtggagcggggtatggtcaagcccaaaggcaaggtgatcgaccttgggtgcggccgaggggggtggagttactacatggccaccctgaaaaatgttaccgaggtcaagggctacacgaagggaggccccgggcatgaagaaccgataccaatggccacctatggatggaacctcgtgaagctacacagcggcgtcgacgtcttttacaagcccacggagcaagtggacacgctgctctgtgacatcggggagagctccagcaacccgacgatagaagaggggcggacccttcgggtgttgaagatggtcgagccctggctttcctcgaagcccgagttttgcatcaaggtattgaacccatacatgccgaccgtgatcgaagaactggagaagctgcagaggaagcacggcggcaacctcgtgcgctgtcccctgtcccgcaacagcacgcacgagatgtactgggtgtccggcgcctcagggaacatcgtatcctccgtcaatacgaccagcaagatgctgctgaaccgtttcaccacccgccaccggaagccaacttacgagaaggacgtggacttgggcgccggaactaggtcagtatcgaccgagacggagaagccagatatgacgatcatcggacggaggttacagcggctacaggaggaacacaaagagacctggcactacgatcaagagaacccgtaccgcacctgggcataccacgggagttacgaggcgccctccaccggcagcgcttccagcatggtcaacggcgtggtgaagctgttaacgaaaccttgggacgtaatcccgatggtgacccaactggccatgactgacaccacgcccttcggtcaacagcgcgtattcaaggagaaggtggacacccgcactcctcagccgaaaccgggcacccgcatggtgatgacaacgactgcaaactggttatgggcattgctcgggaagaaaaagaatccccgcctgtgcacccgggaagagttcatttccaaggttcgctctaacgcagccatcggcgccgtcttccaggaggagcaggggtggacgagcgcgtcggaggcggtgaacgactctaggttctgggaactggtcgataaggaacgcgccctccaccaggaaggcaagtgcgaatcctgcgtgtacaacatgatgggtaaacgagagaagaagctgggggaatttggccgcgctaaagggtcacgcgccatatggtacatgtggttaggcgcacgctttctcgaatttgaggcgcttgggttcctcaatgaagaccactggtttggccgcgagaactcgtggagcggcgtggaaggggagggcctccaccggctggggtacatcctggaagagatagacaagaaggacggcgacctaatgtacgctgacgataccgcgggctgggatacgcgaattaccgaagatgacctgcagaacgaggaactgatcaccgaacaaatggcgccccaccacaaaatcctcgcaaaagctatcttcaaacttacgtaccagaataaggtcgttaaagtcttacggcccacccctcggggggcagttatggacataatttcccggaaagatcagcgcggcagcggccaagttggcacgtacggactcaacaccttcacaaacatggaagtgcaacttatcaggcagatggaggcggagggcgtcattacccaggacgatatgcagaatccaaaaggcctaaaggaacgcgtggagaaatggcttcgggaatgtggtgttgaccgcctgaagcggatggcgatctccggtgacgactgcgttgttaaaccgcttgatgagcgcttcgggaccagcctcctgtttctgaacgatatgggcaaagtgcggaaagacataccccagtgggagccttccaaaggttggaagaactggcaggaggtaccattctgctcacaccacttccacaaaatcttcatgaaagatggccgctcgctcgtagtgccctgccggaatcaagacgaactaatcggtcgagcccgtatcagccagggtgccggttggagtttacgagagacagcgtgcctagggaaagcatacgcgcagatgtggagcctgatgtacttccaccgccgggatttaagactcgctagtatggccatctgcagcgccgtcccaacggagtggttcccgacgtcccggaccacctggtccatacatgcccaccaccagtggatgacaacggaggatatgctgaaagtctggaaccgcgtatggatcgaggataaccccaacatgatcgacaaaacgcccgttcacagctgggaggacatcccctacctcggcaagcgtgaagatttatggtgcgggtcgctaattggtctaagcagccgcgccacctgggccaaaaacatccacacagccataacccaggtccgaaatctcatcggtaaagaggagtatgtggactacatgccggtcatgaagcggtactctgccccttcagagagtgaaggagtgctttga

SEQ ID NO: 26333 - RNA, 9867 nt, synthetic construct
  misc_feature 1..9867: note = derived and/or modified CDS sequence (opt11) from DENV-4__JQ513343__SS-prME
  source 1..9867: mol_type = other RNA
agcacaatcaccctgctctgccttattccgacagtgatggcctttcacctgtccaccagagatggcgagcctctcatgatcgtggcgaagcatgagagaggacgccccctgctcttcaagacaactgaggggatcaacaagtgcacgttgattgccatggatctaggggaaatgtgcgaggacacggtgacctacaagtgccctctcttggtaaacaccgagcccgaggacatcgactgctggtgcaacttgacgagtacctgggtgatgtacgggacgtgcacgcagtcgggggaaagacgacgggagaaacgcagcgtggccctgacgcctcactccggtatgggcctcgagacccgagccgagacctggatgagcagtgagggagcctggaagcacgcccagcgcgtggaaagctggatcctgcggaaccccggcttcgcgctgctcgccgggttcatggcctacatgattggccaaaccggcatacagcgcaccgtctttttcgtgctgatgatgctggtggccccgagctacggcatgcggtgtgtcggcgtggggaaccgcgacttcgtggagggcgtctcggggggcgcgtgggtcgacctcgtgctggagcacggtgggtgcgtaaccacaatggcccagggcaagcccaccctggacttcgagctcacgaagaccaccgcaaaggaagtggccctgctccggacctactgcatcgaggctttgatctcaaacatcacgaccgcgaccagatgtcctacccagggggagccctacctgaaggaggaacaggaccagcagtacatatgccggcgcgacgtggtcgaccggggctgggggaacggctgcggcctgttcggaaagggaggagtggtgacgtgcgccaagttttcgtgtagtggcaagatcacaggtaacttagttcaaatcgagaacctggaatatacggtcgttgtaaccgtgcataatggcgatacgcacgccgtcggcaacgacaccagcaaccacggggtgaccgcaacgatcacgccgcggtcgccttctgtcgaggttaagctgccggactatggcgagctgacgcttgactgtgagccccggagcgggatcgacttcaacgagatgatcctgatgaagatgaaaaagaagacctggctcgtgcacaaacagtggttcctggacctgcccctcccgtggactaccggagccgacacgagcgaggtgcactggaactataaggagcgtatggagacattcaaggtcccccacgcgaagcggcaggacgtgaccctgctggggtcccaggagggcgctatgcacagtgccctcgccggcgccactgaggtcgactccggtgacgagaaccacatgttcgcgggacacctcaagtgcaaggtgcgcatggagaagctgcgcatcaaggggatgtcctacacgatgtgtagcgggaagttctcaatcgacaaggagatggctgagacccagcatgggaccaccgtcgtgaaggtcaagtatgagggcgccggcgctccctgcaaggtgcccatcgagatccgggacgtgaataaagagaaggtcgtgggcagagttatctccgccacacccctcgccgagaacaccaactccgtaaccaacatcgagctggaaccacccttcggcgacagctacatagtgataggtgttggcaactccgccctgactctccactggttccggaagggcagctccatcggaaaaatgttcgagagcacgtaccgcggcgctaaacggatggccatcctgggggagaccgcgtgggacttcggctcagtcgggggcctgttcaccagcttgggcaaggccgtgcaccaggtcttcgggtccgtatacaccacgatgtttggaggggtttcctggatgatcaggatcctgatcggcttcctggtgctgtggatagggacaaacagtagaaacaccagcatggccatgacgtgcatagccgtcggcgggataaccctcttcctggggttcaccgtgcaggccgacatgggctgtgtagtctcctggagcgggcgcgagctcaaatgtggctccggaatcttcgtggttgacaacgtccatacctggaccgagcagtacaagttccaacccgagagccccgcacggttagctagcgctatcctgaacgcccacaaggatggcgtgtgcggcatccgttccacaacgaggctcgagaacgtgatgtggaagcagatcactaacgagctcaactacgtcctgtgggagggcgggcacgatctgaccgtggtggccggggacgtcaagggagtgctaacgaagggcaagcgcgctctgactccgcccgcctcagacttaaagtacagctggaagacctggggcaaagccaaaatattcactcccgaggcccgaaacagcacgttcctcattgacggaccagacacttccgagtgccctaacgagcgccgggcatggaattctttcgaggtcgaggactacgggttcggcatgtttaccaccaatatctggatgaagttccgtgaggggtccagcgaagtctgcgaccacaggctgatgtcggccgccatcaaggatcaaaaggctgttcacgccgacatgggctactggatagagagctccaaaaaccagacgtggcagatcgaacgcgcgagcctgatcgaggttaagacttgtctctggcccaagacccacaccctatggagcaatggcgtcctggaaagccaaatgttgatccccaagtcgtacgccgggccctttagccaacacaactaccgtcagggctacgccacccaaacggtggggccctggcacctggggaagctggagatcgacttcggcgagtgcccaggtacgacggtgacaatccaagagaattgtgaccacaggggcccgagtcttcgcacgaccactgcgagcgggaagcttgtcacccagtggtgttgccggtcatgcacgatgccccccctgcggtttctcggagaggacgggtgctggtacggtatggaaattcgaccactgtccgaaaaggaggagaacatggtcaagagccaggtgactgcgggacagggcacttcagaaaccttcagcatgggcctcctatgcctgacgttgttcgtcgaagagtgcctcagacggcgagtgacccgaaaacacatgatcctggcagttgttattaccctgtgcgccatcatattagggggcttaacctggatggacttgctccgcgccttgatcatgctgggagacaccatgtccggccggataggtggacagactcacctcgcaatcatggccgtattcaagatgagccccggctacgtcctgggggtctttctgaggaagttgacgagccgggagactgcgctcatggtgattggcatggcaatgacgaccaccctgtcgatcccccacgacctcatggagttaatcgacggaatctccctgggtctcatcctgctgaaaatcgtgacccaattcgataacacgcaggtgggaaccctcgcgctgagcctgacgttcatacgctctaccatgtcactggtgatggcttggcggacgatcatggcggttctgttcgtagttaccctgatccccctctgccgcacctcctgcctgcagaagcaaagccactgggtcgaaatcacggctctgatcctcggagcccaggccctgcccgtgtacctcatgacgctcatgaagggcgccagccggaggtcttggccgttaaacgaaggcatcatggcggtgggactcgtctccctcttagggtcagccctgctcaagaacgacgtgccgctggcgggccccatggtagccggcggactgctcctggctgcgtacgttatgtcaggcagctctgccgacctgtccctcgagaaggccgccaacgtgcaatgggacgagatggcggacatcaccgggagctcccccatcatcgaagtgaagcaggacgaggacggcagcttcagcataagggacgtcgaggagaccaacatgataaccttgctggttaaattggcgcttatcacggtgtccggcctgtaccccctcgccattcctataaccatgactctgtggtacatgtggcaagtcaagacccagcgttcaggcgcgctgtgggacgtgcctagccccgccgccacccaaaaagctgccctctccgagggcgtgtaccggatcatgcagagggggttattcggcaaaacgcaggttggcgttggcatccacatggagggggtgttccacaccatgtggcacgtaacgcggggctctgtaatctgccacgaaacgggccgcctcgaaccctcctgggctgacgtgcgcaacgacatgatcagctatggaggggggtggcggctcggcgataagtgggacaaggaagaggacgtccaggtactggccatcgagccgggcaagaacccaaagcacgtgcagactaagccagggctgttcaagaccctcaccggagaaatcggcgccgtaaccctggacttcaagcccgggacatccgggagcccgatcatcaacaggaagggcaaagtgatcggtctgtacgggaatggcgttgtcaccaagtccggggactacgtgagcgctataacgcaggccgaacggattggagaacccgactacgaagtggacgaggacatatttcgcaagaaacggttaacgatcatggacctgcaccctggagcggggaagaccaagcgcatcctgccgtccatagtacgtgaggcattaaagcgccggctccgtaccctgattcttgcacccacccgggtggtggcagccgagatggaggaggcccttcgtgggctaccgattcggtaccagacgcccgccgtgaagtcggaacacacgggacgggagatcgtggatctcatgtgccacgccaccttcacaacccggctcctgtccagcacgcgagttccgaactacaacctaatcgtcatggatgaggcgcatttcacagatccctcgagcgtagccgcccggggctacattagcacccgcgtggagatgggggaagccgcggccatcttcatgactgcgacgccgcctggcgccactgacccgttcccgcagtcgaacagccctatcgaggacatcgagcgcgagatcccagagcgctcgtggaacactggttttgactggatcactgactaccagggcaagactgtgtggttcgtaccgtccatcaaggccggcaacgacatcgcgaattgccttcgcaagtccgggaagaaggtgatccagttgagccgaaagaccttcgacactgagtaccccaagactaagctgacggactgggactttgtcgtgaccaccgatatctccgagatgggtgccaacttcagagccgggcgggtcatcgacccccgccgttgcctcaaacctgtgatactaactgatggcccggagcgcgtgatcctggccgggcccatccccgtcacgcccgcgagcgccgcccagcggcgcggacgcatcggccgcaatccggcccaggaagacgaccagtacgtgttcagtggtgacccattaaagaacgatgaagaccacgcccattggaccgaggccaagatgcttctggacaacatatacacacccgagggcatcatccccaccttatttgggcctgagcgggagaagacacaggcgatcgacggtgaatttcgacttcggggcgaacagcgcaagaccttcgtggagctgatgcggcgcggggacctcccggtctggctcagctacaaagtggcctcagcggggatcagctataaggaccgcgagtggtgcttcaccggtgagcgaaataaccagatcctggaggagaacatggaggtagagatctggacaagagagggcgaaaagaagaagctgcgccccaaatggctcgatgcccgggtgtacgcggacccgatggctttgaaggatttcaaggaattcgcctctgggcgcaagtccatcaccctcgacatacttacggagatcgcctccctgccaacctaccttagctcccgcgccaagctggccttggataacattgtgatgctccacaccaccgaacgaggcggccgcgcctatcagcatgccctgaatgagctgcccgaatcgctcgagacgcttatgttagtggccctcctaggggcgatgaccgccgggatcttcctctttttcatgcaggggaagggcatcggtaaacttagcatgggcctgatcactatcgccgtcgcgtccggcctactatgggtggccgaaatccagccccaatggatcgcagctagcatcatcctggagttcttcttaatggtgctcttgattccggagcccgagaagcagcggacgccacaggacaaccagctgatctacgtcatcctcacgattctgaccattatcgggctgatcgcggccaatgagatgggcttaatagagaaaactaaaaccgattttgggttctaccaggtgaagaccgaaaccaccatcctcgacgttgatctgcgcccggcctccgcgtggaccctctacgccgttgcaacgaccatcttgacgccgatgctgcgtcacacgatagaaaacacgagtgccaacctctcccttgcagcgatcgcgaaccaggccgcggtgctaatgggactcggcaagggctggcccctgcacaggatggacttgggcgtgccgctattagccatggggtgctacagccaggtcaaccccaccaccctgaccgcaagcctagtgatgttgctggtgcactatgccatcatcggcccggggctccaggccaaggcaactcgcgaggcgcagaagcgcactgccgccggcatcatgaagaaccccaccgtcgacggcatcaccgtgatcgacctcgagcccatcagctatgacccgaagttcgagaagcagttgggtcaggtgatgctcctggtcctgtgcgcgggccagctgctgctgatgcggacgacctgggccttctgcgaggtgctcacactggcgaccgggccaatcttaacattatgggagggaaaccccggtagattctggaacaccaccatcgccgtttccaccgcaaacatcttccgcggcagttatctggccggggccgggctggcgttctccttaataaagaacgcccaaacgccccgcagagggaccgggaccactggcgagaccctcggggaaaaatggaagcgccagctgaatagcctcgacaggaaggagttcgaggagtacaagcgctccggcatcctggaggttgatagaacggaagccaagagcgccctgaaagacggttccaaaatcaagcacgctgtgtctcgcgggagctcaaagatccggtggattgttgaaaggggcatggttaagcccaaaggtaaggtaatagatctgggctgcgggcgaggaggctggtcctactacatggccaccctcaaaaacgtgaccgaggtcaaggggtacacgaagggcgggccgggacacgaggagcccatccccatggcaacatacgggtggaacctggtgaagttgcacagcggagtggacgtcttctacaagcccacagagcaggtcgacactctgctgtgcgacatcggcgagtcttcctccaacccgaccatcgaggaagggaggacactacgcgtgcttaaaatggtagagccctggctgtccagcaagcctgagttctgcatcaaagtgctaaacccctacatgccgaccgttatcgaggagctcgagaagctgcagcggaagcacggcgggaacctcgtgcgctgcccgttatcccgcaacagcacccatgagatgtactgggtatccggcgcctctggtaacatcgtatcctctgtgaacacaacgtcaaagatgttgctgaaccgcttcaccacccggcaccgcaagcccacctacgagaaggatgtagacctcggggccggcacgcggtcggtatcgaccgagaccgagaagcccgatatgacgataatagggcgccggctgcagcgtctgcaggaggagcacaaggagacatggcactatgaccaggagaacccgtaccgtacctgggcgtaccacggtagctacgaggccccctccactgggagcgcctcctcgatggtcaacggcgtggtcaagctccttaccaagccctgggacgtaatcccgatggtgacgcagcttgccatgaccgacacgacaccattcggccagcagagagtctttaaggagaaggtagacacgcggacgccccagcccaagcctgggacacgcatggtgatgaccacgacggccaactggttgtgggcgttgctgggcaagaagaagaacccccggctctgcacccgagaggaattcattagcaaggtccggagcaacgccgcaatcggagccgtgttccaggaggagcaaggctggacctctgcctcggaggcggttaatgacagccgcttttgggagttagtcgacaaggagcgggcgctgcaccaggagggaaagtgcgagtcctgcgtctacaacatgatgggcaagagagagaagaagctcggcgagtttgggagagccaagggtagccgggctatttggtacatgtggctgggagcacgcttcctggaattcgaggccctcggattcctaaacgaagaccattggttcgggagggagaactcctggtccggcgtggaaggagagggtctgcaccgcttaggctacattttggaggagatcgacaagaaggacggggatctgatgtacgccgatgacacggccggctgggacacccggataactgaagacgacctccagaacgaggagctgatcaccgagcagatggcgccccaccacaagatcctagccaaagccatcttcaagctaacctaccagaataaggttgttaaggtcctaaggcccactccgcggggcgccgtgatggatatcatctccagaaaggaccaaaggggaagtggccaggtggggacctatggcttaaataccttcaccaatatggaggtgcagctcatcagacagatggaggccgagggagttatcacccaagacgacatgcagaaccccaagggccttaaggagagagtagagaagtggctgcgcgagtgcggcgtagaccgtctaaagcgcatggccatctctggggacgactgcgtcgtaaaacccctcgatgaacggttcggcacctccctcctgttcctaaatgacatggggaaggtgcgcaaggacatcccccaatgggaaccgtcaaaaggctggaagaactggcaggaggtgcccttctgcagccaccacttccacaagatttttatgaaggatggccggtccctggtggtcccctgtcgcaaccaggacgagctcatcggtcgggctcgcatcagccagggcgccggatggtccctgcgcgagacggcctgcctggggaaagcgtacgcccagatgtggtcgctcatgtattttcaccgccgcgacttacgcctggcgtctatggcgatctgtagcgccgtacccacggagtggttcccgactagccgcaccacctggtctatccacgcccaccaccagtggatgacaacggaggacatgttaaaggtctggaaccgcgtatggattgaggacaatccgaacatgatcgataagactcccgtccactcatgggaggatatcccctaccttggaaagcgcgaggacctgtggtgcgggtccctaatcggtcttagctcccgggccacttgggcgaagaacatccacaccgccattacgcaggtacgcaacctgatcggaaaagaagaatacgtggactatatgccggtcatgaaacggtacagcgccccctcggaaagcgagggcgtcctctaa

SEQ ID NO: 26334 - RNA, 9867 nt, synthetic construct
  misc_feature 1..9867: note = derived and/or modified CDS sequence (opt11) from DENV-4__KT276273__SS-prME
  source 1..9867: mol_type = other RNA
agcaccatcaccctgctttgccttatccccacggtgatggcgtttcacttgtcgacccgcgacggcgagccgctcatgatcgtcgccaagcatgagcgggggcgccccctgctgttcaaaaccaccgagggcatcaataagtgtacgctcatagccatggaccttggggagatgtgcgaggataccgtgacctacaagtgccccctccttgtgaacacagagcccgaagacatcgattgctggtgcaacctgacgagcacgtgggtcatgtacggcacctgcacccagtcgggggagcggcgccgggagaagcgcagcgtggccctgacgccgcactccggcatgggcctcgagacccgggccgagacgtggatgagcagtgaaggggcctggaagcacgcacaacgcgtggagagctggatactgcggaacccgggcttcgctctgctcgccgggtttatggcctacatgatcgggcagaccgggatccagcgcacggtcttctttgtgctgatgatgctagtcgccccctcctatggcatgcggtgtgtcggcgtggggaatcgcgacttcgtggagggcgtcagcgggggcgcgtgggtggacctcgtgctggagcacggcgggtgcgtcacaaccatggcccaaggccggcccactctcgacttcgagctgaccaagaccaccgctaaggaggtggcgttactgcgcacctactgtatcgaggcgagcatttcgaacattacaacggccacccggtgcccgacccagggggagccctaccttaaggaggagcaggaccaacagtacatctgccgccgggacgttgtcgaccgcggctgggggaacggttgcggcctattcggaaagggcggggtggtcacgtgcgctaagttttcctgcagcggcaagatcaccgggaacttggttcagatcgaaaacctcgagtacaccgtggtggtaaccgtgcacaatggagacacgcacgcagtcggtaacgacacctccaaccacggggtcaccgccaccatcacgccccggagcccctccgtggaagtggagttaccggactacggcgaactgaccctcgactgcgagccccgctccgggatcgacttcaatgaaatgatcctaatgaagatgaacaagaagacatggctggtacacaagcagtggttcctggacttgcccctgccatggaccgccggggcggacacctccgaggtgcactggaacaacaaggagcggatggttaccttcaaagttccgcacgccaagcgacaggacgtgaccgtcctcgggtcacaggaaggggccatgcacagcgcgttagccggcgcgacggaggtggactccggggacggcaaccacatgttcgccggtcaccttaaatgcaaggtccgaatggagaagttacggatcaagggtatgagctacaccatgtgctcgggcaagttcagcatcgataaggaaatggctgagacgcagcacgggaccactgtggtgaaggtgaaatacgagggcgctggggccccctgtaaggtacccatcgagatccgcgacgtgaacaaagagaaggtgatcggccgagtcatttccagcatacccctggcggagaatacgaactccgtgacgaacatcgagctggagccgcccttcggggacagctatatcgtgatcggcgtcggcaactccgccttaaccctgcactggttccgcaagggtagcagcatcggcaagatgttcgagtccacctatcgcggggccaagcgcatggccatccttggcgagacggcctgggacttcgggtccgtgggcggcctcttcacgtcactcgggaaggcggtgcaccaggtcttcgggtccgtttacaccactatgtttgggggtgtgagctggatgatccggatcctgatcggcttcctcgtcctgtggatcggcaccaacagcaggaatacgagcatggccatgacttgcatcgctgtgggtgggatcaccttgttcctgggcttcaccgtgcaggccgatatggggtgtgtcgtgtcttggagcggacgggaactcaaatgcgggagcggcatcttcgtaatcgacaacgtccatacgtggactgagcagtacaagttccagcccgagtcccccgcgcgcctggcctccgccatcttaaatgcccacaaagacggcgtctgcgggatcagatccaccacccggctcgagaacgtgatgtggaagcagatcacgaacgagctgaactacgtcctttgggaaggcgggcacgatctcaccgtcgtggccggtgacgtgaagggcgtgctgactaagggaaagcgggccctgaccccgcccgcaagcgacctaaagtattcctggaagacgtggggcaaagccaagatcttcacccccgaggcccgcaacagcaccttcctgatcgacgggcccgacacgtcagagtgcccgaacgagaggcgagcctggaacagcctggaggtggaagactacgggtttggcatgttcacgaccaacatctggatgaagttccgggaaggctccagcgaaatgtgcgaccatcgcctcatgtccgcggcaataaaggaccagaaggccgtccacgccgacatgggctactggatcgaaagcagtaaaaaccagacctggcagattgagaaggcgagcctgatcgaggtgaagacctgcctgtggcccaagacgcacaccctctggtctaacggggtgctagagagccagatgctaatacccaagtcgtacgccggtccgttctcacagcataactaccgacaggggtacgccacccagatcgcaggcccctggcacctggggaagctggagatagacttcggtgagtgccccggcaccaccgtcacgatccaggaggactgcgaccaccgcgggcccagccttaggaccaccactgcctccggcaagctcgtgacacagtggtgctgccggagctgcaccatgccgcccctgaggttcttaggggaggacggctgctggtacgggatggagattcggcccctcagtgagaaggaggagaacatggtgaagtcacaggtcgcggccgggcagggcacttccgagaccttctctatggggctactgtgtctcacgctgttcgtggaagagtgcctgcgccggcgagtgactcggaagcacatgatcctcgtcgtggtcatcaccttttgcgccatcatcctaggcggcctgacctggatggacttactgcgcgccctgatcatgctcggggatacgatgtctggccggatcgggggccagatccaccttgcaatcatggcggtgttcaagatgagccccgggtacgtgctgggcgtcttcctcaggaagttgacgtcccgggaaaccgccttgatggtcattggaatggccatgaccacggtgctcagtattccgtacgacctaatggagctgatcgacggcatctccctcggcctcatcctgctcaagatcgtaacccagttcgataacacccaggtggggaccttagccctgagcctcacgttcatccgcagtaccatgcccctggtgatggcctggcggaccatcatggcggtcttatttgtggtgaccctcatacccttatgccgcacgagctgcctgcagaagcagtcccactgggtcgagatcaccgccctcatcctgggcgcccaggctctgcccgtatacctcatgactctgatgaagggggctagccgtaggtcctggccgctgaacgagggcatcatggccgtggggctcgtcagtctgctgggctccgccctcctgaaaaacgacgtgcccctcgcaggacccatggtggcggggggcctcctattggcggcatacgtgatgagcgggtcctccgccgacctcagcctggagaaggccgccaacgtgcagtgggacgagatggcggacattacaggctccagccccatcatcgaggtgaagcaggacgaggatggctccttcagcatccgggacgtcgaggaaacgaatatgataaccctgctggtgaaactggctctgatcaccgtctccggactctacccgctcgccatcccggtcaccatgacgttatggtatatgtggcaggtgaagacccagcggagcggtgctctctgggacgtgccctcccccgccgcgacccagaaggccgcccttagcgagggcgtctaccggataatgcagcgcggcctattcgggaagacacaggtgggcgtggggatccacatggagggcgtctttcatacgatgtggcacgtcacccggggttccgtaatctgccacgagaccgggcgcctcgagccgagctgggccgacgtgcgcaatgacatgatctcctacggagggggctggcgcttgggcgacaaatgggacaaggaggaggacgtgcaggtgctggccatcgagcccgggaagaaccccaagcacgttcagaccaagcccggcctcttcaaaaccctgacgggggagatcggcgcggtaaccctggacttcaagccggggacttcaggctcccccatcataaatcgcaaaggcaaggtcattgggctgtacggcaacggggtcgtgaccaagagcggcgactacgtctcagccatcacgcaggccgaacggatcggggagcccgactacgaggtcgacgaagacatctttaggaaaaagcgcctgaccatcatggacctgcaccctggcgccggcaaaaccaaacgcattcttccctccatcgtacgggaggcgctgaaacgccgtctccgaaccctgatcctcgcacccacgcgggtggtagccgccgagatggaagaggcactgcgaggtttgcccatccggtaccagaccccggcggttaagtccgaacataccggccgcgaaatcgtggacttgatgtgccacgccaccttcacgacccggctgctgagcagcacccgcgtccccaattacaacctcatagtgatggatgaagcccactttaccgacccctccagcgtggccgctcgggggtacatctccacgcgcgtcgagatgggcgaggctgccgccatcttcatgacggccactccccccggggccaccgacccctttcctcagagcaactcccccatcgaggatatcgagagagagatcccggagcgcagctggaacacgggctttgactggatcaccgactaccagggcaagaccgtctggttcgtcccctccatcaaggcggggaacgatatcgccaactgcctgcgcaagagcggcaagaaggtgatccagctgtcacggaagaccttcgacacggaatatcctaagaccaagctcaccgactgggacttcgtggttaccacggacattagcgagatgggagccaacttccgcgccggccgggtgatagacccacgccggtgtctgaagccggtgatcctgaccgacgggcctgagcgcgtaatactcgcgggtcccatccccgtgactccggcatccgctgcccagcggcggggccggatcgggcgcaacccagcccaggaggatgaccagtatgtgtttagcggcgaccccctgaagaacgacgaagatcacgcgcattggacagaagcgaaaatgctgctcgataacatatacactcccgaggggatcatccctacgctgttcggccccgagcgggagaagacccaagcaatcgatggagagtttcgcctgcggggggagcaacgcaagacgtttgtcgagctcatgcggcgcggcgacctccccgtgtggctgtcctacaaggtggccagcgccgggatttcatacaaggaccgggagtggtgctttacgggcgagcgcaacaaccagatcctcgaggagaacatggaggtcgagatctggacccgggagggggaaaagaagaagctgcgcccccggtggttggacgcacgcgtgtacgccgaccctatggcactcaaagacttcaaggagttcgccagcgggcgcaagtcaatcaccctggacatcttgacagagatcgccagcctccccacgtatctgtccagccgggcgaagctggccctcgacaacatcgtgatgttgcacaccaccgagcgaggagggcgggcctaccagcacgccctgaacgagctccccgagagcctggaaaccctgatgctcgtcgcgctcctgggtgccatgactgccgggatttttctcttctttatgcagggcaagggtataggcaagctgtccatgggcctgatcacgatcgcggtggccagcgggctcctttgggtggcggagattcagccacagtggatcgccgcctccattatcttggagtttttcctcatggtcctgctgatccccgagccagaaaagcagcgcaccccccaggacaaccagctcatatacgtgatcttaaccatcctgaccatcatcggcttaatagccgccaacgaaatggggctgatagagaagacgaagacagatttcggcttctaccaggtgaagaccgagaccacgatcctggacgtcgacctccggccggcgagcgcctggaccctgtacgccgtggccacaaccatcctgaccccgatgctccgacacaccatcgagaacacatccgctaatctgagcctggcggccatcgccaatcaggcagcggtgctgatgggtctgggcaagggctggccactgcaccggatggatctcggggtcccgctgctggcgatgggatgctactcccaggtcaacccgaccacactcacagccagcctggtgatgttgctcgtccactacgccatcattggacccgggctccaggccaaggctacccgggaggcccagaaacgaaccgccgcaggcatcatgaagaaccccacggtggacgggatcaccgttatcgacctggagcccatctcctacgacccgaagttcgagaagcagctcggccaggttatgctgctggtgctctgcgctgggcagctgctgctcatgcgcaccacctgggcgttctgtgaggtgctgacgctagccaccggtcccatcttgaccctgtgggaggggaacccaggccggttctggaataccacgattgcggtcagtaccgccaatatctttcgcggctcctatctcgccggggcgggcctagccttcagcttaatcaagaacgcccagaccccccggcgcgggaccggcacgaccggagagaccctcggcgaaaagtggaagcggcagttgaactccctggaccgcaaggagttcgaggagtacaagcggtcaggcatcttagaggtggaccgcaccgaagccaaatccgctctcaaggacggtagcaagatcaagcacgcggtttcccggggcagctccaagattcgctggatagtggaacgcgggatggtgaagccgaagggcaaggtggtcgacctggggtgcggccggggcgggtggagctactacatggcgacgcttaagaacgtgactgaggtgaagggctataccaaggggggccccggacacgaggagcctattcccatggctacctacggttggaacctcgtcaagctgcacagcggagtggacgtgttctataagccgaccgaacaggtcgacacgctgctctgcgacatcggggaatccagctccaacccgaccatcgaggagggccgcaccttacgtgttctgaaaatggtggagccctggctcagctccaagcccgagttctgcatcaaggttctgaacccgtacatgcccaccgtaattgaagaattggagaagctgcagcgcaaacacgggggcaacctagtgcggtgccccctgagccgcaacagtacgcacgagatgtactgggtctcaggtgcatccgggaacatcgtgagctccgtaaataccacgagcaagatgctactcaaccggttcaccacgcgccaccggaagcccacctacgaaaaagacgtggacctgggggcgggaacccgatccgtgagcaccgagacggagaagccggacatgaccatcatcggccggcgcctgcagcggctccaggaggagcacaaggagacttggcactacgaccaggaaaacccctaccgcacctgggcctatcacgggtcctacgaggccccaagcacgggctccgcctcctccatggtaaacggggtagtgaagctgctaaccaagccgtgggatgtcatccccatggttacccagctcgccatgaccgacacgacccccttcgggcagcagcgggtgttcaaggagaaggtcgacacccgtaccccccagccgaagcccggcacccggatggtgatgacgacgacggcgaattggctgtgggctctgctcggtaagaagaagaacccacgcctgtgtaccaaggaggagtttatcagcaaggtgcgggccaacgccgccatcggcgcggtctttcaagaggagcaggggtggacaagcgcttccgaggcggtgaacgactctcgcttctgggagctagtggacaaagagcgggctttacaccaggaaggaaagtgcgagtcctgcgtctacaacatgatggggaagagagagaagaagctgggggagttcggccgcgcaaaggggagccgggccatctggtacatgtggttgggagccagattcctcgagttcgaggccctggggttcctgaacgaggaccactggtttggccgggagaactcctggtctggcgtggagggggaggggctgcaccgcctgggatacatacttgaggagatcgacaagaaggacggcgacctcatgtacgcggacgacaccgcaggctgggacacccgcatcacggaggacgacctacagaacgaggagctaatcacggagcagatggccccccaccacaagatcctcgcaaaagccatcttcaagctcacctaccaaaacaaggtggttaaggtgctgcgccctactccccggggggctgtgatggacatcatcagccgtaaggaccagcggggcagcggacaggtcggtacgtatgggctcaacacctttaccaacatggaggtgcagctgatccgccaaatggaggcggagggagtgattacccaggacgacatgcagaatccaaagggcctgaaggagagggtcgagaagtggctccgcgagtgtggggtggaccggctgaagcggatggcgatctccggggatgactgcgtggtcaagcccctggatgagcggttcgccaccagcctcctgttcctcaacgacatggggaaagtgcgcaaggacatcccgcagtgggagccctccaaggggtggaagaactggcaggaggttccattctgctcgcaccatttccataagatctttatgaaggacggacggtccctcgtcgtgccctgccggaatcaggacgagctgatcggccgtgcacgcatctcccagggcgctgggtggtcgcttaaggagacggcgtgcctcgccaaggcctacgcccagatgtggagcttgatgtacttccaccgccgggatctgcggctcgcctcgatggcgatctgcagtgccgtgcccacggagtggttccccacaagcaggaccacctggtccatccacgcccaccaccaatggatgaccaccgaggacatgctgaaggtgtggaaccgcgtctggatcgaggacaaccccaacatgatcgacaagaccccggtacactcatgggaggacatcccgtacctgggcaaacgagaggatttgtggtgcgggtcattaatcggcctgagctcccgggccacgtgggcaaaaaacatccacaccgcgataactcaggtacggaatctcatagggaaggaggagtatatggactacatgcccgttatgcggagatacagcgccccatccgaaagcgagggcgtgctctaa

SEQ ID NO: 26335 - RNA, 9867 nt, synthetic construct
  misc_feature 1..9867: note = derived and/or modified CDS sequence (opt11) from DENV-4__KU523872__SS-prME
  source 1..9867: mol_type = other RNA
agcaccatgaccctgctctgcctgatccccacggtgatggccttccacctgtctacccgcgacggcgagccgctaatgatcgtggctaagcacgagcgggggcgccccctgctgttcaagaccaccgagggcattaacaagtgcaccttgatcgcgatggacctgggtgagatgtgcgaggacaccgtgacctacaagtgccccctgctcgtgaacaccgagccggaggacattgactgctggtgcaacctgacctcgacatgggtgatgtacgggacctgcacccagagcggtgagcggcgccgcgagaagcgcagcgtggccctgacgccgcactccggcatgggcctcgagacccgggccgagacctggatgagctccgagggcgcctggaaacacgcccagagagtggagagctggatcctccggaacccagggttcgcactgctcgccgggtttatggcccacatgatcggccagactggtatccagcgaacggtcttttttgtgcttatgatgctggtggcgccgtcctacggcatgcggtgcgttggagtcgggaaccgcgacttcgtggagggagtcagcgggggagcgtgggtggatctagtgctggagcacggcgggtgcgtcactaccatggcccagggcaagcccaccctggacttcgagctcacgaaaacgaccgctaaggaggttgcgctgctgcggacctattgcatcgaggcttccatctctaacataacgaccgcgacccgctgtcctacccagggggagccctacttgaaggaggaacaggaccaacagtatatatgccggcgcgacgtggtcgaccggggctgggggaacggctgcggcctgttcgggaagggcggcgtggttacgtgcgccaagttctcctgcagcggcaagatcaccgggaacctggtccagatcgaaaaccttgagtacaccgtcgtcgtcaccgtgcacaacggcgacacacacgccgtcgggaatgacacctccaaccatggggtgaccgccaccatcacgccccgctcaccctccgtggaggtaaagctgccggactacggcgagctgaccctcgactgcgagccccggagcgggatcgacttcaatgagatgattctcatgaagatgaagaagaagacctggttagtgcataagcaatggttcctcgacctccccctaccatggaccgccggcgcggacacttcggaggtgcactggaactacaaggagcgcatggtcacatttaaggtgccacacgccaagcgccaggacgtgaccgtcctcgggagccaggagggggccatgcacagcgcactggcaggggcgaccgaggtggacagtggggacggcaaccacatgtttgccgggcatcttaaatgcaaggtgcgcatggagaagcttcgcattaagggcatgagctacaccatgtgctccggcaagttcagcatcgacaaggagatggccgaaacgcaacacgggaccaccgtcgtgaaagtgaaatacgagggcgcgggggccccctgcaaagtccctatcgagatccgtgatgtgaacaaggagaaggtggtcggccgcatcatctcaagcacccccttcgccgagaacacgaactcggtgacaaacatagagctggagccgccgttcggggacagctacatcgtgattggggtcggcgactctgccctgacccttcactggttccggaaggggagctccataggcaagatgtttgagagcacctacaggggggccaagcggatggccatcctgggcgaaactgcgtgggacttcgggtccgtggggggcctgttcaccagcctcgggaaggccgttcaccaggtctttggctccgtgtacaccaccatgttcgggggcgtgagctggatgatccgcatcctcatcgggttcctggtcctctggatcggtacgaactcccggaataccagcatggcgatgacctgcatcgccgtgggcgggatcacgctattcctgggcttcactgttcaggccgacatggggtgcgtcgtgtcctggaacggcaaggagcttaagtgcggaaacggaatcttcgtggtcgacaatgtgcacacatggaccgagcagtacaagtttcagcccgagagccccgcgcgcttggccagcgcgatcctgaacgcccacaaggacggtgtgtgcgggattcggtccactacgcgccttgaaaacgtcatgtggaagcagatcaccaacgagctcaattacgtgctgtgggagggcggacacgatctgaccgtggtcgccggcgacgtgaaaggcgtgctcacgaaggggaagcgggcgctgacgccgcccgttaacgacctgaagtacagctggaagacctggggcaaggccaaaatcttcaccccggaggcccgcaactcaaccttcctcatcgacgggcccgacacgagcgagtgcccgaacgagcgccgcgcctggaacttcttcgaggtggaggactacggctttgggatgttcacgacaaacatctggatgaagttcagagaaggctccagcgaggtctgcgaccaccgcctgatgtccgccgcgataaaggaccagaaggccgtccacgccgacatgggctattggatcgaaagctccaaaaatcagacctggcagatcgagaaggccagcctgatagaggtaaagacttgcctctggcccaaaacgcacaccctgtggtctaacggcgtcctggagagccagatgttgatcccacggtcatacgcgggacccttcagccaacacaattacaggcaggggtacgccacccagaccgctggcccctggcacctgggaaagctggagatcgactttggcgagtgtcccggtacgacggtgactatccaagaggactgcgaccaccgggggccctccctcaggaccacgactgctagcggcaagctggtgacgcaatggtgctgccgctcctgcaccatgccgcccctgcggttcctgggagaggacggctgctggtacgggatggagatacgccccctgagcgagaaggaggagaatatggtcaagagccaagtaacggcgggccagggcacctccgagacattcagcatggggctgctctgccttaccctgttcgtggaggagtgcttgcgccgccgggtcacgcgcaagcacatgatccttgtagtggtcatcaccttttgcgcgattattctaggcggtctcacctgggtggacctgctgcgggccctcatcatgcttggcgacacaatgtccggtcgcatcggaggccaaatccacctcgccatcatggccgtgtttaagatgagccctgggtacgtattgggcgtgttcctgcgtaagctgacatcccgcgagaccgccttaatggtgatcggtatggcgatgaccaccgtttttagcatcccgcatgacctgatggagctcatcgatggcatctccctcggcctgatcctgctcaagatcgtgacgcacttcgataacacccaggtggggaccctagctctgtcactcaccttcatccggagcacgacccccctggtcatggcctggagaaccatcatggccgtgttcttcgtagtcaccctgatccccctctgccggaccagctgcctgcagaagcagtcccactgggtggagatcaccgctctgatcctcggcgcgcaggccctgcccgtgtacctgatgaccctcatgaagggtgcgagccgccggagctggccgctgaatgagggcatcatggccgtcggcctggttagtctcctgggcagtgcgctgctcaaaaacgatgtgcctctggccgggcccatggtcgcagggggcctgctcctggccgcctacgtgatgagtgggtcaagcgcggacctgtccctcgagaaggccgccaatgttcagtgggatgagatggccgacattactggaagcagcccggtcatcgaggtgaagcaggacgaggacgggtccttctccatccgcgacgtggaggagacgaacatgatcaccttattggtcaagctcgccctgatcactgtgtccggcctgtacccgctagcgatccccgtgaccatggccatctggtacatatggcaggtcaagacgcagcggtctggcgccctgtgggacgtgccctcccccgctgccacccagaaggcgaccctgagtgagggggtgtatcgcatcatgcagcggggcctcttcggtaagacccaggtcggcgtggggatccacatggagggggtgttccacaccatgtggcacgtcacgcgcgggtccgtgatctgccacgagaccgggcggctggagcccagctgggccgacgtgcgcaacgacatgatctcctacggcgggggctggaagttaggcgacaagtgggacaaggaagaggacgtccaggtgctcgccatcgagcccgggaagaaccccaaacacgtgcaaaccaaacccggtctgttcaagaccctgacgggtgagattggcgccgtcaccctcgacttcaagccagggactagcggctcccccatcatcaacaagaagggcaaggtgatcgggctgtacggcaacggggtcgtcaccaagagcggcgactacgtgtccgctatcacgcaggcggaacgcatcggggagcccgactatgaggtggacgaggatatcttcaggaagaagcgcctgacgataatggacctccacccgggcgccggcaagaccaagcgcatactgccatcgatcgtccgcgaggccctgaagcggcgcctcaggaccctcatcttggcccccactcgcgtggtggcggcagagatggaagaggcgctccgcggcctgcccatccgataccagaccccggccgtcaagtccgaacacacaggacgggagatcgttgaccttatgtgccacgccaccttcacgacccggttactcagctctacgcgggtccccaactacaacctgatcgtcatggacgaggcgcacttcaccgacccctgcagcgtggccgcccggggctacatttccacgcgggtcgagatgggtgaggctgccgcgatcttcatgaccgcgacgcccccgggtagcatcgacccctttccccagagcaactctcccattgaagacatcgagcgcgagatcccggagagaagctggaacactggcttcgactggatcacggactaccagggcaagaccgtttggttcgtgccctccattaaggccgggaacgacattgccaattgtctccgcaaatccggcaagcgggtcatccagctctccaggaagaccttcgataccgagtatcccaagacgaagctaaccgactgggacttcgttgtgaccaccgatatcagcgagatgggggcgaacttccgcgcaggccgggtcatcgatccccgcaggtgcctgaagccggtgatcctcacggacgggcccgagagggtgatcctggccggcccgataccagtcacccctgccagcgccgcgcaacgtcgcggtcggatcggtcgcaaccccgcccaggaggacgatcagtacgtgttcagcggcgacccgttacggaacgacgaggatcatgcacactggaccgaggccaagatgctcctggacaacatctacacgcccgaagggataatcccgacgctgttcggcccagagcgcgaaaagacccaggctattgacggcgagttccggctgcgcggggagcagaggaaaaccttcgtcgagctgatgcgccggggagacctgcccgtctggctctcgtataaggtggcgagcgctggcatctcctacaaggaccgcgagtggtgtttcaccggcgagcggaacaaccagatcctggaggagaacatggaggtggaaatatggactcgcgagggggagaagaagaaactccggcccaagtggctcgacgcccgagtctacgccgacccgatggccctgaaggacttcaaagagttcgctagcggccggaagtccatcactctggacatcctcaccgagatcgccaccctgccaacctacctgtcgtccaaggcaaagctcgccctggacaatatcgtgatgctgcacaccaccgaaaaaggcggccgcgcctaccagcacgctctcaatgagctgcccgagagtctggagaccctcatgttagtggcgttgctcggggccatgaccgccgggatctttctgttcttcatgcaggggaaggggatcggaaaactgtccatgggactaattgcgatcgcagtcgcttcagggctcctgtgggtggccgagatacaacctcagtggatcgcggcttccatcatcctcgagttcttcctgatggtgctgctgatccccgagcccgagaagcagcgcacgccccaggacaaccagctgatctacgtaatcttgaccatcctcaccatcataggcctggttgccgccaacgaaatggggctgatcgagaaaaccaagacggacttcgggttctaccaagtgaagaccgagaccaccatcctcgatgtcgacctgcggccggccagcgcctggactctttacgctgtggccaccaccattctcaccccaatgttacgccacacgatcgagaacacaagcgccaacctgtcactcgccgccatcgcgaaccaagccgccgtgctgatggggctgggcaagggatggcccctccaccggatggacctgggggtccccctgcttgccatcggctgttacagccaggtcaacccgaccaccctgacggccagtctggtgatgctcctggtccactacgcgattatcggaccgggcttacaggccaaggccacacgggaggcccaaaagcggaccgcagccggcatcatgaagaaccccacggtggacgggatcacggtgatcgacctcgagcccatcagctatgacccgaagttcgagaagcagctgggccaggtcatgctgctagtcctgtgtgtcgggcagctgctcttgatgcgcaccacctgggccctgtgtgaggtccttaccctggccacgggccccatcatgaccttgtgggaggggaatcccggccggttctggaacaccaccatcgccgttagtaccgcgaacattttccgtggcagttacctcgccggggccggcctggccttctccctgatcaagaacgcgcagacgccccggcgtgggaccggcactacaggtgagaccctcggggagaagtggaagcggcagttaaacagcctggaccgcaaggagttcgaggagtataagcgttccggcatcctcgaggtggaccgcaccgaagccaagagcgccctgcgggacggatccaagactaagcacgccgttagccggggctcctcgaagatccgctggatagtggagcgcgggatgatcaagccgaaaggcaaggttgtcgacctggggtgcggacggggcgggtggtcctactacatggcgactctcaagaacgtaacggaggtgaagggctataccaagggcggcccggggcacgaggaacccatccccatggccacctacgggtggaacctcgtcaaactgcatagcggcgtcgatgtgttctacaagccgaccgagcaagtcgacacgctcctgtgcgacattggggaatccagctccaaccccaccatcgaagagggcaaaacccttagagtgctcaagatggtcgaaccgtggctcagcagcaagccagagttttgcatcaaggttctgaatccttatatgccaaccgtgatagaggagctcgagaagctgcagaggaggcacgggggctccctagttcgctgcccattgagccggaactcgactcacgagatgtactgggtgtctggcgcgtccggcaacatcgtaagctccgtcaacacgatcagcaagatgctgctgaaccgcttcaccacgcggtaccgcaagcccacttacgagaaggacgtggacctgggggccggaacccggtccgtgagcaccgagacagagaagccggacatgactataatcggccgccggctacagcgccttcgggaggagcacaaggagacatggcactacgaccaagaaaacccctacaggacctgggcataccacgggtcatacgaagccccctccaccggctcagcgagctctatggtcaacggcgtagtgaaactgctcactaagccctgggacgtcgtgcccatggtgacccagttagccatgaccgatactacgcctttcgggcagcagcgggtcttcaaagagaaggtggatacccgcacgccgcagccgaagcccggtactcggaagataatgactaccaccgccaattggttgtgggcgctccttgggaaaaagaagtccccacgcctgtgcacccgggaggagttcatatccaaggtgcgaagcaatgccgcgatcggggccgtctttcaggaggagcagggttggacgtccgccagcgaggccgtgaacgacagtcggttctgggagttagtcgacaaagagcgcgccttgcaccaagagggccggtgcgagtcttgcgtgtacaacatgatgggaaagcgcgagaagaagcttggggagtttggcagggccaaggggagccgagccatctggtacatgtggctaggcgcccgcttcctggagttcgaggccctggggttcctcaacgaagatcactggttctcccgggagaattcctggtcaggcgtggagggcgaggggctgcaccgcctgggctacatcctcgaggatatagacaagaaggacggtgacctcatctacgcggacgatacagcgggctgggacacccggatcacggaggatgacctcctcaacgaggagctgatcactgagcagatggcaccccaccacaagacactggccaaagccatcttcaagctcacctaccagaacaaggtggtcaaggtgttacgccccacccccaagggggcagtgatggacattatcagcagaaaagaccagaggggatccggccaagtcgggacatacggcctgaacacgttcaccaacatggaggtgcagctcatccggcagatggaagcagagggggtgattacccaggacgacatgcagaatcccgaaggcctgaaagagcgtgtcgagaagtggctgaaagagtgcggcgtggaccggctcaagcgtatggccatcagtggggacgattgcgtggtcaagccactggacgagcggttctccacgtcactcctgtttctgaatgatatgggaaaggtgcgcaaggacatcccgcagtgggagcccagcaaggggtggaagaactggcaagaggtgcccttctgctcgcaccatttccacaagatcttcatgaaggacggccggtccctggttgtgccctgccgcaaccaggacgagctaatcgggcgggcccgcatcagccagggagccggctggtccctgcgggagacggcgtgtctgggaaaagcctacgcccaaatgtggagcctcatgtactttcaccggcgcgacctgcggctggcctcgatggccatctgcagcgcggtgccgaccgagtggtttcccaccagccgcacgacgtggagcatccatgcccaccaccaatggatgaccacagaggatatgctcaaggtctggaatcgggtgtggatcgaagataaccccaacatgaccgataagacgcctgttcatagctgggaagacatcccgtacttaggaaagcgggaagacctgtggtgtgggtccctcatcggcctgagctcccgggcaacgtgggcgaagaatatccacactgctatcactcaggtgcgcaacctaatcgggaaggaggagtacgtggactacatgcccgctatgaagaggtacagcgcccccttcgagtccgagggcgtactctga

SEQ ID NO: 26336 - RNA, 9867 nt, synthetic construct
  misc_feature 1..9867: note = derived and/or modified CDS sequence (opt11) from DENV-4__KP140942__SS-prME
  source 1..9867: mol_type = other RNA
agcaccattaccctgctctgcctgatccccacggttatggccttccacctgtccacacgtgacggcgagcccttaatgatcgtagccaagcacgagagagggcgccctctgctgttcaaaaccacagagggaatcaataagtgcacgttgatcgcgatggacctgggagagatgtgcgaggacacagtgacttacaagtgtcctctactcgtcaatacagagcccgaagacatagattgctggtgcaacctgacaagcacgtgggtaatgtacgggacctgcacccagtccggcgagcggcgacgggagaagaggtcagtggccctaacaccgcactccggaatgggtctagagacccgcgccgagacctggatgtcctccgagggggcctggaaacacgcccagagagtagagagctggattctgcgcaacccaggcttcgctctgctagccgggttcatggcctacatgatcggccagactggtattcaacgcaccgtcttcttcgtgctgatgatgctggtggccccctcctacggcatgcggtgcgtcggcgtaggaaaccgagattttgtggagggcgtaagtgggggcgcgtgggtggacctggtgctggagcatggcgggtgcgtcaccaccatggcccagggccggcccactctggacttcgagctcactaagacgaccgcgaaagaggtggccctgctgcgcacctactgcattgaagcctccatcagcaatataactaccgcgacacgatgtccgacacagggtgagccttacctcaaggaagagcaggaccagcagtacatatgtcgccgggacgttgtcgaccgcgggtgggggaatggttgtggcctgttcgggaagggcggggtggtaacttgcgccaagttctcctgtagtggcaagataaccgggaacctggttcagattgagaacctcgaatacacggtggtggtcaccgtgcacaacggcgacacgcatgcagtagggaacgacacgtccaaccacggggttaccgcaaccatcactccgaggagcccctccgtggaagtcgaacttccggactacggcgagctgaccctcgactgcgagcctcgctctgggattgactttaatgagatgatactcatgaagatgaataagaaaacgtggctggttcacaagcagtggtttctcgatttacccctgccatggacagcgggcgcggacacctccgaagtacactggaataacaaggaaagaatggtcaccttcaaagtgccgcacgccaagcgccaggacgtgactgtcttgggtagccaggagggcgccatgcatagcgccctggccggcgcgaccgaggtggactccggggacggcaaccacatgttcgctgggcacctgaagtgcaaggtgcgaatggagaagttgcgtatcaagggcatgagctacaccatgtgctccggcaaattcagcatagacaaggagatggcggagacgcagcacgggaccaccgtcgtgaaggttaagtatgaaggtgcgggggccccttgcaaggttcctatcgagatccgcgatgtgaataaagagaaggtgatcggccgcgttatttccagcatccccctggcggagaacaccaactctgtgaccaatatcgaactggaaccgccctttggggatagctatattgtaattggcgtcggtaactccgccctcaccctgcactggtttcgtaaaggaagctccattggcaagatgttcgagagcacataccgtggggccaagcgcatggccatcctgggtgaaaccgcctgggatttcgggtcagttggcggactctttacgagcttggggaaggccgtgcatcaggtcttcggctcggtgtatacaaccatgttcgggggcgtgtcctggatgataaggatcctgatcgggttcctcgtcctgtggatcgggaccaactcccgcaatacatcaatggcgatgacctgtatcgccgtaggagggatcaccctgttcctgggcttcaccgtgcaggccgacatgggctgcgtcgtttcctggagtggccgcgagctcaaatgcgggagcgggatctttgtgatcgacaacgtccacacgtggacagagcagtacaagtttcagcccgaatctccggcgagactggccagcgccatcctgaacgcccacaaggacggcgtgtgcgggatacggagcaccacccgcctcgagaatgtcatgtggaaacagatcacgaatgagctgaactacgtcctgtgggagggcgggcatgacctaaccgtggtggcaggagatgtcaagggcgtcctgaccaaaggaaagcgggcgttaaccccgcccgccagcgatctgaagtattcctggaagacttggggcaaggccaagatattcactccggaggcacgcaacagcacgttcctgatcgacgggcccgacacctccgagtgcccgaacgagcgccgcgcctggaacagccttgaagtggaggattatgggtttgggatgttcacgaccaacatctggatgaagttccgggagggctccagcgagatgtgcgaccaccgcctcatgtccgcggccataaaggaccagaaagccgtccacgccgacatgggctattggatcgaaagctccaagaaccagacgtggcagatcgagaaggcgtcactgatagaagtcaagacctgcctgtggcccaagacccacaccctttggtctaacggggtgttggagtctcagatgctgatccccaaatcttacgccggcccgttcagccagcataactaccgtcagggatacgccacccagatcgccggcccctggcatctcggaaaacttgagatcgacttcggcgagtgccccggcaccacagtgactattcaggaggactgcgaccaccgcggccccagcctgcgcactaccaccgcgagcggcaagctcgtgacccaatggtgctgccggagttgcacgatgcccccactgcgctttctgggcgaggatgggtgttggtacgggatggagatccggccactctcggagaaggaggagaacatggttaaaagccaggtcgctgcaggccaggggacatccgagaccttcagcatggggttgttatgcctcacgctgtttgttgaggagtgcttacgccggcgcgtgaccagaaagcacatgatcttggcggttgtgatcacactgtgtgccatcatcctgggagggctcacgtggatggacctgcttcgcgctctcatcatgttaggcgacacgatgtctggccggatgggggggcagactcacctggctatcatggcggtcttcaagatgagccccgggtatgtactcggggtgttccttcgcaagctgacatccagagaaaccgccctcatggtcatcgggatggccatgacgacgacgcttagcatcccgcacgatctgatggagctgatcgacggtatctccttgggcctgattctcctgaaaatcgttacccaattcgacaacactcaagtgggcaccctggccctgagcctgaccttcatccgctcaaccatgtctctcgtcatggcctggcggacgataatggctgtcctcttcgtggtcaccctgatccccctgtgccgtacctcctgtttgcagaagcagtctcattgggtggagattacagccctgatcttgggtgctcaggcgctcccggtctaccttatgacgctaatgaagggggcgtcgaagcggagctggcccctcaatgaagggatcatggcagtcggtcttgtctcgctgctcggctcagccctcttaaagaacgacgtgccgctcgccggacccatggtggccggcgggctgctgctcgctgcgtatgttatgtccggctcaagcgccgatctgtctctggagaaagccgcaaacgttcagtgggacgagatggcggacataaccgggagctctcccattatcgaagttaaacaggacgaagacggtagctttagcatccgcgacgtggaggagaccaacatgatcacgctcctggtgaagctagccctcattaccgtcagcggcctgtacccgctagccatcccagttacaatgaccctctggtacatgtggcaggtcaagacccagcggtccggcgccctgtgggacgtccccagccccgccgccacgcagaaggccgccctgagcgagggagtgtacaggatcatgcaaaggggtctcttcgggaagacacaggtgggggtaggtattcacatggagggcgtcttccacacaatgtggcacgtaacccgcggcagcgtaatttgccacgaaaccgggagactggagccctcctgggccgacgtgcgtaacgacatgatcagctatggcgggggctggcgcttaggtgataagtgggacaaagaagaggacgtgcaggtcctcgcgatcgagccggggaagaatcccaagcacgtgcagactaagcccggactgttcaagaccctgaccggcgagataggcgcggtgaccctagatttcaaacccgggacgtccggcagcccgatcattaaccggaagggcaaagtaatcgggctgtatggcaacggggttgttaccaagtccggtgactacgtcagcgctataacccaggcagaacgtatcggggaacccgactatgaagtggacgaggatatcttccgcaagaagcgcctgaccatcatggacttacaccccggcgctggtaagaccaagcggatcctaccgtccattgtgagagaggccttaaagcggcgcctgcgcacccttatcctggccccgaccagagtagtggctgccgagatggaggaggcactgcggggcctccccatccgctaccagactcccgcagtcaagtcggagcacactggaagggagatcgtcgacctgatgtgtcatgccacctttaccacgcgcctgctgagctccactagagtaccgaactataacctgatcgtaatggacgaggcccacttcacagatccctctagcgtcgccgcccgcgggtacatcagcactcgggttgagatgggagaggccgccgctatttttatgactgccacgccccccggggcgactgacccgttccctcaatcgaactcccccatcgaggatatcgagcgcgaaatccctgaacggtcctggaacaccggcttcgattggatcaccgactatcagggcaagacggtctggttcgtcccgagcatcaaggccgggaatgacatcgctaactgcctgcgcaaatcgggaaagaaggtgattcagctcagccgcaagacatttgacaccgagtatcccaagaccaagctgactgactgggatttcgtcgtgacgaccgacatcagcgagatgggtgccaacttccgggcgggtagagtgatagacccccgcagatgtctgaagcctgtcattctaaccgacggtccggagcgcgtcatccttgccggacccatcccagtgacccccgccagcgccgcccagagaaggggccgcatcgggcggaaccctgcgcaggaagacgaccaatacgtgttttcgggcgaccccctgaagaacgatgaggatcacgcccactggaccgaggcaaagatgcttctcgacaatatctacaccccggaagggatcatccccaccttgtttggccccgagcgggagaagactcaggcgatcgacggagagttccggctccgcggggagcagcgcaagacattcgtggagttgatgcgccgaggcgaccttcccgtatggttgtcgtacaaggtcgcgtccgcaggaatctcgtacaaggatcgcgagtggtgcttcactggagagcggaataaccaaatcctggaggaaaatatggaggtggagatctggacccgcgagggggagaaaaagaagctgcggcctcgctggttagacgcccgggtgtatgccgacccgatggccctgaaggacttcaaggagttcgcttctggccgcaagagcctgacgctcgatatcctgaccgagatcgcgtccctgcccacctatctctcgtcgcgcgccaagctggccctagataacatcgtcatgctccacactacggagcggggcgggcgggcgtaccaacacgcgctgaacgagctccccgagtccctcgagacccttatgttggtggctctcctaggcgccatgactgcagggatcttcctgttctttatgcagggcaaggggatcggaaagctcagcatgggcctgatcaccatagccgtggcgtccgggctgctctgggtcgccgagatccagccccagtggatcgccgcctccatcatccttgagttctttctgatggtgctcctgatccctgagcccgagaaacagcgaacgccccaggacaatcagctgatatacgttatcctcactatcctgaccatcatcggcctgatagcggcgaatgagatgggtctgatagagaagaccaagaccgatttcggcttctaccaggtcaagacggagaccaccatactggacgtggatctgcgaccagcctcggcctggactttatacgccgtcgccacaactatcctcaccccgatgctgcggcacacgatcgagaatacgagcgctaatttgtccctcgccgctatcgccaaccaagccgccgtactcatggggctcgggaagggctggccccttcatcgcatggacctaggggttccgctcctggccatgggctgctactctcaggtgaatcccacgactctgacggcctccctggtcatgcttttggtgcactacgccatcatcgggccgggcctccaggcgaaggccacgcgggaagcccagaagcgcaccgctgccggcatcatgaagaaccccaccgtggacgggatcaccgtcatcgatctggaacccatcagctacgaccccaagttcgagaagcagctgggacaggtaatgctcctggtgctgtgcgcaggccagctgctcctgatgcggacgacctgggcgttctgtgaggtcttgaccctggccacgggtccgatactaacgctctgggaggggaacccgggacgcttctggaacaccaccatcgccgtgtcaaccgccaacatcttcagaggttcctatctcgccggggctggtctcgccttcagcttgattaagaacgcccagactcctcgccggggcaccggcacgaccggggagacgctgggcgagaagtggaaacgccagcttaactcactcgaccggaaagagttcgaggagtataagcgctccggcatcctggaagtggaccgcaccgaggccaagagcgcgctgaaggatgggtccaagatcaaacacgccgtgtcaagaggctcgagcaagatccggtggatcgtagagagaggcatggtgaagcccaaaggcaaagtcgtggatctcggttgcggccgcggtggttggagctactacatggccaccctcaagaacgtcaccgaagttaagggatacacgaaaggcggacctggtcacgaggagcccatccccatggccacgtacggctggaacctggtgaagcttcactccggcgtggacgtcttttacaagcctacagagcaagttgatactctgctctgcgacataggggagagctccagcaacccgaccatcgaggagggccgcactcttcgcgtcctgaagatggtcgagccctggttgtcaagcaagccagaattctgcataaaggtgctgaacccctacatgcctaccgtgatcgaggaacttgagaaactgcagcggaagcacgggggcaacctggtccgctgcccgctatcccggaactccacccacgagatgtactgggtatccggcgcaagcgggaacatcgtgtccagcgtcaacactacgtccaaaatgctgctgaaccgcttcactacgcggcatcgcaaaccaacctacgagaaggacgtggatctcggcgccgggactcggagtgtctccaccgagaccgagaagccagacatgaccatcattggccgccgactgcagcgcctgcaggaggagcacaaagaaacgtggcactacgaccaggagaatccgtaccggacttgggcctatcacgggagttacgaggccccctcaaccggttcggcctccagcatggtgaacggcgtggtcaagttactgacgaagccatgggacgtgatcccgatggtgacccagctggcgatgaccgataccacccctttcgggcaacagagagtcttcaaggagaaggtcgacacccggacgccccagcccaagccgggaactcgaatggtaatgaccacgaccgccaattggctctgggccctgctggggaagaagaagaacccccggctctgcactaaagaggagttcatcagcaaggtccgagcgaacgcagcgatcggagcagtattccaagaggagcaagggtggacaagtgccagtgaggcagtgaacgactcccggttctgggaactggtggacaaggagagggcgttgcaccaggagggaaagtgcgagtcttgcgtatacaacatgatgggcaagcgggaaaagaagctcggggagttcggtcgcgccaaggggtcccgcgccatctggtacatgtggctaggcgcccggtttctggagttcgaagcccttgggtttctgaacgaagatcattggtttggccgcgagaacagctggtccggcgtggagggggagggtctgcacaggctcgggtacatcctagaggagatcgacaaaaaagacggcgacctaatgtatgcggacgatacggccggttgggacacaaggatcaccgaggacgacctccaaaatgaggagctgatcaccgagcagatggcaccccaccacaagatactcgccaaagccatcttcaaactaacgtaccagaacaaggtcgtgaaggttctgcggccgaccccgcgaggggcggtcatggacattatttcacggaaggaccaacgcggttcaggccaggtgggcacgtacgggctgaacaccttcaccaacatggaggtgcagctcatccggcaaatggaagccgagggcgtgatcacacaggatgacatgcagaaccccaagggactgaaggagcgagtggagaagtggcttcgggagtgcggggttgaccggctcaaacgtatggccatcagcggcgacgactgtgtagtgaagccactggacgagcgctttgcaacctccctcctgttcctgaacgatatgggtaaggtacggaaggatatcccccagtgggagccaagcaaaggctggaaaaactggcaggaagtccccttttgctcccaccacttccataagatcttcatgaaggacgggcgcagcctggttgtgccgtgccggaaccaagatgagctcatcggccgcgcccggatctcccagggcgctggatggtcgctgaaggagaccgcctgtctggccaaggcctacgctcagatgtggtccctcatgtactttcacaggagggacctgaggctggctagcatggccatatgtagcgcagtcccaaccgagtggttcccgacatcccgcaccacatggtctatccatgcgcaccaccagtggatgaccaccgaggacatgctcaaagtctggaaccgggtgtggatcgaggacaaccccaacatgatcgataaaacccccgtccactcctgggaggacattccttacctgggcaagcgagaggacctatggtgtgggtctctgataggcctgtccagccgggccacctgggcgaagaacatccacaccgctatcacccaggtccggaaccttatcgggaaagaagagtacatggactatatgccggtgatgcgacgttactccgcaccctcggaaagcgagggcgtcctctga

SEQ ID NO: 26337 - RNA, 9867 nt, synthetic construct
  misc_feature 1..9867: note = derived and/or modified CDS sequence (opt11) from DENV-4__KU523871__SS-prME
  source 1..9867: mol_type = other RNA
tcgaccatgaccctattgtgcttaataccgacagtaatggccttccatttaagcacacgggatggagaacctctgatgatagtggcaaaacacgaacgagggcgcccgctgctattcaaaacgacggaaggaattaacaaatgcaccctgatagcaatggacttaggcgaaatgtgcgaagatacagtcacctacaaatgccccctgctggtaaacaccgaacccgaagacatagactgttggtgtaacttaacatccacatgggtcatgtacgggacgtgcacacaaaatggggaacgccgaagagaaaagagaagtgtcgctctcacaccacactccgggatggggctagaaacacgagcagaaacatggatgtcaagcgaaggggcgtggaagcacgcacaacgagtcgaatcctggatactgcgaaacccagggttcgcactcctggcggggttcatggcatacatgatcggacaaaccggcatacaacgcatagtgttcttcgtactaatgatgttggttgccccatcgtatggtatgagatgcgtgggtgtaggcaaccgcgacttcgtcgaaggcgtaagcggaggggcatgggtcgacctggtcctagaacacggcggatgcgtcaccacaatggctcagggaaaaccaacgctggacttcgaactgacgaagacaactgcgaaagaagtagcactattacgtacgtactgcatcgaggcctcaatctcgaacatcacaacagccaccagatgtcctacgcaaggggagccgtatctaaaagaggagcaagaccaacaatacatatgccgaagagacgtcgtagacagagggtgggggaatggctgtgggctattcggcaagggaggggtagtcacgtgcgccaagtttagctgttcaggtaaaataacaggaaatcttgtgcaaatagagaatctggagtacacagtcgtcgtcaccgtgcacaacggagatacccatgcagtcggaaacgatacatctaaccacggtgtaacagcaaccataacaccaagatccccctcagtcgaagtaaaactcccggattacggcgaactgaccctagactgcgagcctagaagcggaatagatttcaatgagatgatactcatgaagatgaaaaagaagacgtggcttgtacacaagcaatggttcctcgacctcccgctgccatggaccgcaggcgcagacacctcggaagtacactggaaccacaaagagcgcatggtcacgttcaaggtccctcatgccaagaggcaagacgttacagtcttgggctcccaagagggagcgatgcactcagcgttagccggggccacggaggtagactccggagacggaaaccacatgttcgcgggacatctaaaatgtaaagtacgtatggagaagctgaggatcaaggggatgtcttataccatgtgcagcgggaagttcagcatcgacaaagaaatggccgaaacccaacacgggacgactgtagtcaaggtaaaatacgaaggcgcaggagctccctgcaaagtaccgattgagatcagagatgtaaacaaggaaaaagtagtaggacgaatcattagttccacaccgttcgcggagaacacaaactcggtcaccaatatcgaactagaaccgccattcggcgatagctacatagttatcggcgtcggagaaagcgctctcactcttcattggttcaggaagggatcgagcatcggtaagatgttcgaatccacataccgcggcgcgaagcggatggccatcctaggcgaaaccgcctgggattttggaagcgtgggtggactattcacttcccttggcaaggcggttcaccaagtgtttgggtctgtctatactacaatgttcggaggcgtctcatggatggttcgaatacttatcggattcttagtactctggatcggtacaaactcgagaaacacaagcatggcaatgacctgtatagcggtaggtggcataaccctgttcctaggcttcacagtacaagccgacatgggatgcgtagtgagctggtccggcaaggaactaaagtgcggctcaggaatattcgttgtagacaatgtccatacctggacagaacaatacaaattccaacccgagagccccgccagattggcatcggcaatactcaacgcacacaaggacggagtctgcggcatccgctcaacgacaagactggagaatgtgatgtggaagcaaattaccaacgaactcaactatgtgctgtgggaaggtggccacgacctaactgtagtggcgggagacgtcaaaggggtattaaccaggggaaaaagggcgctaacaccaccagtaaacgacttaaagtactcctggaaaacgtggggcaaagcaaaaatttttactcccgaagcgagaaacagtacattcttaattgatggtccggatacaagtgaatgccccaacgagagacgggcctggaacttcttcgaagttgaagactatggattcggcatgttcactactaacatttggatgaaattcagagagggctccagtgaagtatgcgatcaccgattaatgtccgccgccattaaggaccagaaagcagtacacgccgatatgggctattggatagagtcgtccaagaaccaaacatggcaaatagaaaaagcgagcctaatagaagtaaagacgtgcctatggccgaaaacgcacacgctgtggagcaacggagtcctagaatcccaaatgctaattccgcggtcgtacgcgggaccatttagtcagcacaactacaggcagggctacgcgacacagactgtcgggccttggcacctgggaaagctggagatcgatttcggggaatgcccgggaaccacggtcgccatacgggaagactgtgaccatcgaggaccttcgctgcgaacgaccacagccagcggcaagctcgttacacaatggtgttgtcgtagctgcacaatgccgcccctgcgtttcctcggggaggacggctgctggtatggcatggaaattagacccctatcagaaaaggaggaaaacatggtaaagtcccaagcaacggccggccagggcacgtccgagacttttagcatgggactcctttgcctcaccctcttcgtagaagaatgcctgagacgacgagtcacgaggaagcacatgatactggtcgtagtaatcacattctgcgcaatcatactcggaggtctaacgtggatggacctcttacgagccctcataatgctcggggatacaatgagtggaaggataggtgggcagatacatctagcaataatggctgtgttcaagatgagtcccggatatgtactaggcgtgttccttcgtaaattgacaagccgagagaccgctctcatggttatagggatggctatgacaaccgtattctccatcccgcacgatctcatggagttgatcgacggcatcagcctcggtctgatactactaaagattgtgacacacttcgacaacactcaagtggggacgctcgccctatcactcaccttcctacgcagcactacccccttagtaatggcctggcgaacgatcatggcagttttctttgtagtcacgctcataccgctgtgccgcacgagctgcctacaaaaacagagccattgggtagaaataacagcgctaatactaggcgcccaggcactccccgtgtatttgatgaccctcatgaagggagccagcagacgatcctggccgctcaacgaaggtatcatggcagtggggctagtaagcctattaggctcagcactgctcaaaaacgacgtccccctggcagggccgatggtcgcaggcggcctactacttgcagcgtacgtcatgtcgggaagctcagccgacctaagtctggaaaaagcagccaacgtacaatgggatgagatggcggacataaccggatcttcacccattattgaagtcaagcaagacgaagatggcagcttctcgattcgggacgtcgaagaaacgaacatgatgacactactggtaaaacttgctctaatcacagtctccggattgtaccccctcgccataccagtgacaatggccctctggtacatatggcaagtaaagacacaaagaagtggtgcgctatgggatgtcccatcccccgcagcaacccaaaaggcaacactgtcggagggcgtgtatcgaataatgcaacggggactattcggcaagacgcaggtaggcgtaggcatacacatggagggggtttttcacacgatgtggcatgttacccgcggttcggtaatatgccacgaaacaggacgactggaaccgagctgggccgacgtacgtaatgacatgatcagctatggtggagggtggaggcttggcgacaaatgggacaaagaggaggacgtgcaagtgctggcgatcgagcccggcaaaaatccgaagcacgtccaaaccaaaccaggtctgttcaaaacattaacgggcgaaatcggagcggttacgctcgacttcaagcccggaacgagcggctcgccaatcataaacaagaaaggcaaggtaatcggactttacgggaacggagtcgtgacaaaaagtggcgactacgtgagcgccatcacacaggctgaaagaatcggcgagccagactacgaagtagacgaagacatcttcagaaagaagcgcctgaccattatggatttacatccaggtgcgggaaaaacgaagagaatactaccgtccattgtccgagaagcgcttaagcggagactccgcacgctcatcctcgcacccacacgggtagtagcagcagaaatggaagaagccctacgaggcttgccgatcagataccagacaccagcggtcaagagcgaacacacaggcagggagatagtagatctgatgtgccacgccacattcaccacacgactgctttcctccacccgagttccaaactacaaccttatcgtaatggacgaggcacactttaccgatccctgcagcgtcgccgctcgcggctacataagcacacgcgtcgagatgggtgaagccgcagcgatctttatgacagcgacaccaccgggggcgaccgatccgtttccgcaatcgaactcgccaatcgaagacatcgaacgtgaaataccggaaaggtcctggaacactggtttcgactggatcacagactaccaaggaaagactgtctggttcgttccgagcataaaagcgggcaacgacattgcaaactgtctgagaaaatccggaaagcgagtaatacagctatcacgcaagaccttcgatacggaatacccaaagaccaaactaacagactgggacttcgtggtaacaacggacatttcagagatgggagccaacttccgcgccgggcgagtaatagacccaagacggtgtctaaaacccgtaatactaaccgacgggccagagagggttatattagcaggcccaatacccgtaactccagccagtgcagcacaaagaagaggccgcataggaaggaaccccgcgcaagaagacgaccaatatgtgttctctggggacccacttaaaaatgatgaagaccacgcccattggaccgaggccaaaatgctgctggacaatatatacacgccagagggaatcattccaacccttttcgggcccgagcgcgagaagacacaagctatagatggggagttccgcctccggggcgagcaaagaaaaaccttcgtcgaactcatgaagagaggagacctgccagtctggctcagctacaaggtagccagtgcggggattagttacaaggacagggagtggtgcttcacgggggaacggaacaatcagatcctggaagagaatatggaggtggagatatggaccaaagagggcgagaaaaagaaactacggcctaaatggctagacgccagagtctacgcagaccccatggccctgaaagacttcaaagagttcgcgagtgggcgaaaatccataacgctcgacatactcaccgagatcgcatcactacccacctacctcagcagcaaggcgaaactcgcactcgataacattattatgctccatactaccgaaaaagggggacgagcataccagcatgccctaaacgaactgccagagagcttagagaccctcatgctcgtggcgcttcttggggcgatgaccgccggtatttttctgtttttcatgcaggggaagggaataggaaagttaagcatggggctcatcgccattgcggtggcatcaggattgctatgggtcgcggagattcagccccagtggatagcggccagcataatcctggagttctttctaatggtccttctaatacccgaaccggagaagcaaagaacaccacaggataaccagctgatatatgtaattctaaccattttgacgataatcggcctgatagcggcgaacgagatggggctaatcgagaagacaaagacggacttcggattctaccaagtgaaaaccgagactactatacttgatgtagacctaaggcctgcaagcgcatggacactctacgcagtagccactacgatcctgacccctatgctccggcacacaatcgaaaacacaagtgcgaacctctcgctggccgcaatagcgaaccaggctgcagtgctaatgggactagggaaaggatggccattacacagaatggacctgggtgttccattattagcgataggctgttactctcaagtcaacccaaccaccttaaccgcgtcgctggtaatgctcctggtccattacgcaatcatcggcccagggctccaggcaaaagcgaccagagaagcccagaaacgaacagccgcaggcatcatgaaaaatcccacagtcgacggcataacagtaatcgatctggagccaatttcgtacgatcccaaattcgaaaagcaactaggccaagtgatgttgctagtactatgcgcaggccagctcctgttaatgagaacaacatgggcactctgcgaagtgctaacactcgccacaggaccagcaatgaccctgtgggaaggtaacccaggccgcttctggaatacgaccatcgccgtcagcacagccaatatattcagaggctcgtacctcgccggtgcaggcctagctttttccctaatcaaaaacgcacaaacgcctcgaagggggacaggaaccacgggagaaacgctaggtgaaaaatggaaaagacagttaaatagcctagatcggaaggagttcgaggaatacaagcgcagcggtatactagaagtcgaccgcaccgaggcaaagagtgccctgaaggacggatcaaaaatcaaacatgctgtgtcccgcgggagctcgaagataagatggatcgtagagagggggatggtcaaaccgaaaggtaaggtcgtagacctaggctgcggcagagggggctggtcgtactacatggccacactgaaaaacgtaaccgaggtcaaggggtacacgaagggcggcccagggcacgaggaaccaatcccgatggctacgtacggctggaacctagtcaagctacacagcggtgtggacgtattttacaaaccaacagaacaggtagacaccctcctctgcgacatcggggaatctagcagcaaccccactatagaagaagggcgcactctccgcgtgttaaagatggttgagccatggttaagctccaaaccagagttctgcataaaagttctgaacccatacatgccgaccgttattgaggagttagaaaaactccaacggcgccacgggggcagtctggtgagatgcccattatcccgcaattccacccacgaaatgtactgggtaagtggggcctccggaaacatcgtcagctcagtaaacacaatctcgaaaatgctcctaaaccgattcacaaccagacaccgcaaacctacatatgaaaaggacgttgatctgggcgcaggaaccaggagcgtctcaacagaaaccgaaaaacccgacatgaccattatcgggagacgactccaaagactcagggaggaacacaaggaaacatggcactacgatcaagaaaatccatacaggacgtgggcatatcatggatcatacgaagctccatcgaccggcagtgctagttccatggtgaacggcgttgtcaaactactcacaaagccttgggacgtcgtcccaatggtgactcaactggccatgaccgacaccacgccttttggacagcagagagtcttcaaggaaaaggtcgatacccgcaccccacaacccaaacccggaactagaatgataatgactacaactgcgaactggttgtggaccctcctgggcaagaagaaatcaccacgtctatgcacccgagaagagttcatctccaaggtacgaagcaatgctgccataggagccgttttccaggaagaacagggatggacatcggcctccgaagcagtcaacgacagtcgcttctgggagctggtagacaaagagcgcgcacttcaccaagaaggcaaatgtgaaagctgtgtatacaacatgatgggcaagcgggagaagaaactcggagagttcggccgagcgaaaggaagcagggcaatgtggtatatgtggctgggggcaagatttctggagttcgaggctctagggttcctcaacgaggaccactggttctcacgcgagaactcctggtcgggcgtggaaggcgaagggctacaccgactcggatacattcttgaggacatagacaagaaggatggtgatctcatatacgccgatgacacggctggctgggacacccggatcacggaagacgaccttttaaacgaagaactgatcaccgaacaaatggcaccacaccacaagacactggcaaaagcaatcttcaagctaacctaccaaaacaaggtcgtcaaggtccttcgcccaacacccaaaggcgcagtaatggacatcatatcgaggaaagaccaaagaggcagtggccaggtcgggacgtacggattaaatacgttcactaacatggaggtacaactcatccgacaaatggaagcagagggcgtaatcacgcaagacgacatgcaaaaccctaaaggactgaaagaacgagtcgagaaatggttgacagaatgcggggtagaccggctcaagcggatggccataagcggggatgactgcgtagtgaaaccactagacgaaagattctccacatcactgctattcctcaacgatatggggaaagtgaggaaggacatacctcaatgggaaccctcgaaaggttggaaaaactggcaagaggtcccattctgcagccaccacttccacaagatcttcatgaaagacgggaggtccttggtcgtaccctgccgaaaccaagatgagctgatagggcgagcgcggataagccaaggggcaggatggtccctgcgcgagacggcttgcttgggaaaagcgtatgcacagatgtggagccttatgtacttccacaggcgggacttaaggctcgcaagcatggccatatgcagcgcagtaccgacggagtggttccctacaagtcggactacctggagcatccacgcccaccaccagtggatgaccaccgaagatatgctgaaggtctggaaccgcgtatggatcgaagataaccctaacatgacagacaaaacgcctgtttactcatgggaggatatcccatacctcggaaaacgagaagatctgtggtgtggcagtctgatcgggctatcgagccgggcgacgtgggccaagaacatccacacggcgataacacaagtaagaaacctcatcggcaaagaagattacgtagactacatgccgatcatgaaacgctacagcgcgcccagtgagtcagaaggcgtcctctaa

SEQ ID NO: 26338 - RNA, 9867 nt, synthetic construct
  misc_feature 1..9867: note = derived and/or modified CDS sequence (opt11) from DENV-4__HQ332175__SS-prME
  source 1..9867: mol_type = other RNA
tctaccattaccctgctctgcctgattcccactgttatggctttccacctttcaactcgtgacggggagcccctcatgatcgtcgccaaacatgaacgggggcgcccgctgctgtttaaaaccaccgagggcatcaacaaatgcacgctcattgcgatggatctgggtgagatgtgcgaggacaccgtgacatataagtgccccctgctcgtgaacacagagcccgaggatatcgactgttggtgtaacctgactagcacctgggtcatgtatggaacctgcacgcagagcggggagcgccgccgggagaagcggtcggtggctctcacgccgcacagcgggatgggtcttgagacccgtgccgaaacctggatgagctccgaaggggcttggaagcacgctcagcgtgtcgagtcatggatcctgaggaaccccggcttcgcgctgctggccgggtttatggcttacatgataggccaaaccgggatacagcgaacggtcttcttcgtgctcatgatgctggtggccccctcttacgggatgcggtgcgtcggggtggggaatcgcgacttcgtggaaggcgtcagtgggggcgcgtgggtagacctcgtgttggagcacggcggctgcgttaccaccatggcccagggaaagcccaccttggacttcgagctcacgaagacaacggcgaaagaggtcgctttattgcgtacttactgcatcgaagcactcatctccaatatcacgaccgcgacacgctgcccgacccagggggagccctacctgaaagaggagcaggaccagcagtacatttgccggcgcgacgtcgttgacaggggatgggggaatggctgcggactgttcgggaaaggcggggtggtaacatgcgcgaaattcagctgctccggtaagatcacggggaacctcgtgcagatcgagaacctggaatacaccgtggtggttaccgtgcacaacggggacacacacgcagttggtaacgacaccagcaaccatggggtaactgccaccatcacgccccgatccccgagtgtggaggtgaagctgccggactacggagagcttaccttagactgcgagccacgtagtggcattgactttaacgaaatgatactaatgaaaatgaagaaaaagacctggctcgtgcacaagcagtggttcctggatcttccgctcccctggaccaccggcgcagacacgagcgaggtgcactggaactacaaggagcgcatggtcacctttaaggtgccgcacgccaaacgacaggacgtgaccgtcctgggttcgcaggaaggagccatgcacagcgcactggctggtgcaacagaggtggacagcggagatggcaatcacatgttcgctgggcatctcaagtgtaaggtgcgcatggaaaagctgcgcatcaagggcatgtcctacacgatgtgcagtggcaaatttagtatcgacaaagagatggccgagacccaacatgggacgaccgtggtgaaggtcaagtacgagggagcgggcgccccctgcaaggtccccatcgagatccgggacgtgaataaagaaaaggtagtcggcagagtgatcagcgccacgcccctcgcggaaaacactaattccgtgaccaacatcgagctggagccgccttttggggacagctacattgttattggggtgggcaactccgccctgaccctgcattggttccggaagggcagctcgatcggaaaaatgttcgagtcgacttacagaggggccaagcggatggccatactgggagagacagcgtgggatttcgggtctgtaggaggcctgttcaccagcctggggaaggccgtccaccaagtgttcggctccgtgtacacaactatgttcgggggcgtctcctggatgatccggattctcattggattcttggtcctgtggatcggcactaactccagaaatacgagcatggccatgacgtgcatagcggtaggcggtatcacgctgttcctcggattcacagtccaggccgacatgggctgcgtagtatcgtggtccggtcgggagcttaagtgcggttctggcatattcgtcgtggacaatgttcatacatggaccgagcaatacaagttccagcccgagagccccgccaggctggccagcgctatcctcaacgcccataaggacggcgtctgcggcatccgctccactaccaggctggaaaatgtgatgtggaagcagataaccaacgagctgaactacgtgctctgggagggcgggcatgacctaaccgtagtggccggggacgtgaagggtgtcctgacgaaagggaaacgcgctttgaccccgcctgccagcgatctaaagtactcctggaagacatgggggaaagcgaaaatcttcaccccggaagcacggaactcaacgtttctgatcgacggccccgatacctctgagtgtcctaacgaaaggagagcctggaatagcttcgaggtggaagattacgggtttgggatgttcactacaaatatctggatgaagttcagggagggcagtagcgaggtatgcgaccacaggctcatgagcgccgccatcaaggaccagaaggccgtccacgccgacatgggctactggattgagagctctaagaatcaaacgtggcagatagaacgcgcctccctaatcgaggtgaagacctgcttgtggccaaaaacgcacaccttgtggtccaatggcgtgctggagagccagatgctcatccccaagtcctacgcaggtcccttcagccagcacaactacaggcaggggtatgccacccagacggttggcccttggcacctcgggaagctagagatcgacttcggagaatgccccggaactaccgtaacaatccaggagaactgcgaccatcgtggaccctccctgaggactaccaccgccagcggcaaactcgtgacgcagtggtgctgtcggtcctgtacgatgccgcctctgcggttcctgggggaggacggctgctggtatggcatggaaatccggcccctctcagagaaggaggaaaatatggtcaagagccaggtaaccgcaggccagggcacgtccgaaaccttctctatggggctgctttgccttacgctgtttgtcgaagagtgcctgcgccggcgcgttacacgaaagcacatgattttggccgtggtgatcaccctgtgtgccataatcctgggcgggctgacatggatggacctgctgcgcgccctcattatgctgggcgatacgatgagtggacggataggaggccagacccacctggccataatggccgtcttcaagatgagccccggctatgtgctcggggtcttcctgcgaaagctgacctcccgggagaccgcgttaatggtgatcggcatggcaatgactaccaccctgagcatcccgcacgatctaatggaactcatcgacggaatcagcctgggcctgattctgctgaaaatcgtcacccaattcgataacacgcaggtcggtacgttggctctctccctgaccttcatcagatccaccatgtcattggtaatggcctggcggacaatcatggcggttctctttgtggtgaccctgatcccactatgccgcacctcctgccttcaaaagcaaagccactgggtggagatcactgcgctgatacttggcgcccaggcacttcccgtctacctgatgacgttaatgaagggggcctctcggcgcagctggcccctaaacgagggaattatggcggtggggctggtgagtctgctcggcagcgccctgctgaaaaacgacgtcccactggccggcccaatggtggccggaggcttacttctcgccgcgtacgtgatgtccgggtcctcagtcgatttgagcctggagaaggcggccaacgtgcagtgggacgaaatggccgacatcaccggcagctcccctatcatcgaggtgaagcaggatgaagatgggtccttctccatccgtgacgtagaggaaacaaacatgataaccttgcttgtgaaacttgccctcatcactgtgagcggcttataccctctggcgatcccgattacgatgaccctctggtacatgtggcaagtaaagacccagcgatcgggcgccctgtgggatgtgccgagccccgccgcgacccaaaaggccgcgttgtccgagggggtctaccggatcatgcagcgaggcctctttggaaagacacaggtaggagtagggattcacatggaaggcgtatttcatactatgtggcatgtcacaaggggaagtgtgatctgtcatgagaccggaaggctagagccctcatgggccgacgtgcgaaatgacatgattagctacggagggggctggcggttaggggacaagtgggacaaggaggaagacgtccaggttcttgctatcgagccggggaagaatcccaaacatgtgcagacgaagccaggcctgttcaaaaccctgaccggagagattggtgccgttaccctcgacttcaagcccgggaccagcggcagcccgatcatcaaccgcaagggcaaagtgattgggctatacggcaatggagttgtcactaagtccggtgactacgtcagcgccattacccaggccgagcgaataggggagcctgactatgaggtggacgaggacatcttccgcaaaaagcggttaaccataatggacttacatccgggggcaggtaaaacgaagcgaatcctaccgtcgatagtgagggaggccctgaagcgtaggctgcgtactctcatccttgcccccacccgcgttgtggcagcagagatggaggaggcgctgcgtggcctccccatccggtaccaaacccccgcggtcaagtcggaacacaccgggcgggaaatcgtagacctgatgtgtcacgccaccttcacgaccagactgctctctagcactagggtccctaattataacctaatcgttatggacgaggcccacttcaccgatcccagcagcgttgccgcccgggggtacataagcactagagtcgagatgggcgaggcggccgccatcttcatgaccgccacaccgcctggggccaccgacccatttccgcaaagtaattcgccgattgaagacatcgagcgggagatccccgagcgctcatggaacaccggctttgactggataaccgactaccagggcaagactgtttggttcgtacctagcatcaaggctgggaacgacatagccaactgcctgcgcaagtccgggaagaaggttatacaactcagccggaagaccttcgataccgaataccccaagacgaagctgacggactgggatttcgtggtgaccactgacatctcagagatgggtgcaaactttagggccggccgggtcatcgacccccgcagatgtctgaaacccgtgatcctcactgacggcccggagcgcgttatactggccggtcccatccccgtcactcctgcctctgccgcacaacgccgaggccggatagggcgcaatccagcacaagaagatgaccaatacgtgttttcgggcgaccccctcaagaacgatgaggaccatgcacactggaccgaggcaaaaatgctcctggataatatctacacaccagaaggaatcatccctacccttttcggaccggaacgtgagaagacgcaggcgattgatggagagttccgcctccggggtgaacagagaaagaccttcgttgagttaatgcgtcgcggagacctgccagtatggctcagctacaaggtggcctccgccgggatcagctataaggatagagagtggtgcttcaccggtgagaggaacaaccaaatcctggaggagaacatggaggtggaaatctggacccgcgagggggagaaaaagaagctgcgccccaagtggctcgatgccagagtgtacgcagacccaatggcgctgaaggattttaaggagttcgcctcaggaagaaagagcataacactcgatatcctcaccgagatagccagtttgcccacgtaccttagttcacgggccaagctagccttagacaacattgtgatgttgcacaccaccgaacggggagggcgtgcatatcagcatgctctcaacgaactacctgagtctttggagacgctcatgctggtggccctcctcggcgcgatgacggctgggatcttcctcttcttcatgcagggcaaggggatcggcaagttgtcaatgggcctcatcaccatagccgtcgcctccggcttgctgtgggtggccgagatccaaccccagtggatcgcggcgagcatcattttggagttcttcctaatggtgctgctcatcccggaaccagagaagcagcgcacaccccaggacaaccagttgatatacgtcatcctgacgatcctcaccataatcggcttgatcgcagctaatgagatggggctgattgagaaaactaagaccgatttcggcttctaccaggtgaagaccgaaaccaccattttggacgtggatctccggcccgcctccgcctggaccctgtacgcggtcgccactaccattctcacacccatgctccgtcatacaatagagaatacgagcgcgaacttaagtttagcggccattgcgaaccaggctgccgtgctgatgggcctgggcaagggctggccattacaccgaatggacttgggggtacccctgttagccatgggctgctacagccaagtcaacccgaccacgctgaccgcttccctagtgatgctcctggtccactacgcaataattgggccgggactgcaggcgaaggccactagagaagcccagaaacggaccgcagccggcataatgaaaaaccccacagtcgacggcatcacagtaatcgatctcgaacccatctcttatgaccccaagttcgaaaagcagctaggccaggtgatgctgctggtcctttgcgccgggcaactgctcttgatgcggacaacatgggccttctgcgaggtgctcacgttggccaccgggcccatattgacgctgtgggaggggaaccccgggcgcttttggaatactactattgcagtctctacggcaaacattttccggggttcctacctggccggggcaggccttgccttcagccttatcaagaacgcacagactcccaggcggggcaccggcaccaccggcgagaccctgggcgaaaagtggaaaaggcagctgaactctcttgaccggaaggagttcgaggaatataagcgatccggtattttggaggtcgaccgcacagaggccaaatcagcgttaaaggacggctccaagatcaagcacgccgtgagcaggggctcctctaaaatacggtggattgtggagcgcgggatggtcaaacccaagggaaaggtggtcgacctcgggtgtggccgcggcggctggtcgtattacatggccaccctgaagaacgtcacagaggtgaagggctacacaaaaggagggcccgggcacgaggagccgattcccatggcgacgtacggctggaaccttgtgaagctgcatagcggcgtcgatgtgttctacaagcccacggaacaggtggacaccctcttatgtgacataggagagagtagtagcaacccaacaatagaagagggtcggacgctgcgcgtgctcaagatggtggagccctggctttccagtaagccagagttctgcatcaaggtactgaacccctacatgccaaccgtgatcgaagaactcgagaagttgcagcggaagcacggcggcaatctagtgcgctgccccttatcccgtaactcaacccacgagatgtactgggtctccggagcgtccggtaacatcgtttccagcgtcaacacaacgtccaagatgctcctgaacaggttcacgacccggcaccgcaagccgacatacgagaaagacgttgacctaggtgccggtacacggtctgtgtccacggaaaccgagaagcccgacatgacgattatcggccgccggctccagaggttacaggaggagcacaaggagacctggcactacgaccaggagaacccctaccggacttgggcctaccacgggtcctacgaagcaccctccaccgggtcggcttccagcatggtgaacggagtcgttaagctgctgaccaaaccctgggatgtgatccctatggtcacccagctggccatgaccgataccacccccttcgggcagcagagggtgtttaaagagaaagtagacacgcggacgccccaacccaagcctggcacccgcatggtaatgacgacgacagcgaattggctgtgggccttactcgggaaaaagaaaaacccacgcctgtgcaccagagaagagttcatttccaaggtgcggagcaatgctgcgatcggagctgtgtttcaggaggagcaagggtggacgtccgccagcgaggcagtcaacgacagccgcttctgggagctggtcgacaaggagcgggcgttacaccaggagggcaagtgcgagagctgtgtctacaacatgatgggtaagcgtgagaaaaagttaggggagttcggacgcgctaaggggagcagagcaatctggtacatgtggctcggtgcacgcttcttggagttcgaggctctggggttcctcaacgaagaccactggttcggcagagaaaattcatggagcggagtagaaggggaaggattacataggttagggtacatcttggaggagatcgacaagaaagacggcgacttgatgtacgcagacgatacagccggctgggacaccagaatcaccgaggatgacctgcagaacgaggagctcatcaccgagcagatggcccctcaccacaagatcctggcgaaggcgattttcaagctcacctaccaaaacaaggtggtgaaggtcctccgccccacgccgcggggcgcagtgatggacatcatttcacgcaaggatcagcgagggtccgggcaagtgggtacctacgggctgaacaccttcacgaatatggaagtccagctgatcagacagatggaggccgaaggtgtgatcacacaggatgacatgcagaacccaaagggactcaaggagagggtggagaagtggctgcgtgagtgcggggttgaccgactgaagagaatggcgatctcgggcgacgactgcgtggtgaagcccctcgacgagcgcttcgggaccagcctgctgttcctcaacgatatgggcaaggtacgcaaggacataccccaatgggagccctccaagggttggaagaactggcaggaggtgcccttctgtagccatcactttcacaagatattcatgaaggacggccgttctctggtcgtcccctgtcgcaaccaggatgagctgatcggccgggcccgcatcagccagggggcgggttggtccctccgcgaaactgcctgcctgggtaaagcctacgcgcagatgtggagcctcatgtatttccatcggagggaccttcggctggccagtatggcgatctgctccgcagtgccgactgaatggttcccaacaagtcgtaccacatggtcaatccatgcgcatcaccagtggatgaccacagaagacatgctgaaggtatggaatcgggtctggatcgaggacaaccccaacatgatcgacaagaccccagtccatagctgggaggatatcccttaccttggcaagcgcgaagacctgtggtgcggcagtttaatcggcttgtcatcccgggctacctgggctaagaacatacacaccgcgattgcgcaagtgagaaacctcatcggcaaggaggagtacgtggactacatgccagtaatgaagcggtactcggcaccctccgagagcgagggggttctgtga

SEQ ID NO: 26339 - RNA, 9867 nt, synthetic construct
  misc_feature 1..9867: note = derived and/or modified CDS sequence (opt11) from DENV-4__HQ332172__SS-prME
  source 1..9867: mol_type = other RNA
agtacgattaccctgctctgtctgatacccacggtgatggcctttcacttgagcacccgcgacggcgagccgctaatgattgtcgccaagcacgaacgtgggcgccccctgctatttaaaaccacggagggcataaacaagtgcacgttgattgcgatggacttgggcgaaatgtgtgaagacaccgttacctacaagtgtcccctgttggtgaataccgaacccgaagacattgactgctggtgtaatctgacaagtgcttgggtcatgtacggtacttgcacccagtctggggagcggcgtcgggaaaagcgcagcgtagccctgacccctcattccggcatgggcctcgagacgcgggccgagacctggatgagctccgagggcgcctggaagcacgcgcagcgcgtagaaagctggatcctgcggaacccaggcttcgccctgttagccgggttcatggcgtacatgatcggacagaccgggatccagagaacggttttcttcgtgctgatgatgctagtggcgccgtcatacgggatgcggtgtgtaggggtggggaatagggacttcgtggagggcgtctccgggggcgcatgggtggacctcgtgctggagcacggcgggtgcgtcacgaccatggcccagggcaagccgacccttgacttcgagctcaccaaaacgactgccaaagaggttgccctgctcaggacttattgcattgaagcgctcatctccaacatcacgacggcaacccgctgccctacccaaggggagccctatctaaaggaagagcaagaccagcaatacatctgccggcgcgatgtggtcgaccgtggttggggtaatggctgcggcctattcgggaaaggcggagtggtgacctgcgccaagttttcctgctctggcaagataacggggaacctcgtccagatagagaacttagagtacaccgtggtggtgaccgtccacaacggtgacacccatgcagtcggcaatgatacgagcaatcatggtgtgaccgccactatcacgcccaggtcgccgagcgtggaagtcaagcttcccgactacggcgagctgacgctggactgcgagccccgttccgggatcgacttcaacgagatgatcctaatgaagatgaagaagaagacctggctcgtgcacaagcaatggttcttggacctccccctcccctggactaccggcgcggacaccagcgaggtgcactggaactacaaggaacgcatggtcacctttaaagtcccacacgccaagcgtcaggacgtgacggtcctggggtcccaggagggcgccatgcacagcgccctggccggcgcgacggaggtggacagcggggacggaaaccacatgttcgccgggcatttaaaatgcaaggtgcgcatggagaagctgcgcataaagggcatgtcatacaccatgtgcagcggaaaattctccatagataaggagatggccgagacccagcacggcaccactgtcgttaaggtgaagtatgagggggctggggccccctgcaaggtacccatcgagatccgggatgtaaataaggaaaaggtggtcgggcgcgtgatcagtgcaacccccttagccgagaacacgaactccgtgacgaacatcgagctcgagccgcccttcggtgacagctacatcgtcatcggcgtgggcaactccgcgttgactctgcactggtttcggaaggggagctccatcggcaagatgttcgagtcaacctaccgtggggccaaacggatggcgatcctcggcgagacggcctgggacttcggatcggtgggtggccttttcacctcactgggtaaagccgtccaccaggtgttcggctctgtctataccaccatgtttgggggcgtcagctggatgattaggatcctcattgggttcctggtgctttggatcggcacgaacagccggaacacaagcatggccatgacttgcatcgccgttggcgggatcacgctgttccttggctttacggtccaggcggacatggggtgcgtggtgtcctggagcggccgcgagctgaagtgcgggagcggcattttcgtagtcgacaacgtgcacacctggaccgagcagtacaagttccagcccgagtctcccgcccgcctggcctcggccatcctcaacgcccataaagatggggtctgcgggattcgatctaccacgaggctggagaacgtgatgtggaagcaaattaccaacgagctgaactacgtgctctgggagggggggcacgacctgaccgttgtggcgggggacgtgaagggcgtcctgaccaaggggaagcgcgcgcttacgccccctgccagcgacctgaaatactcctggaaaacctggggcaaggccaagattttcactcccgaagcccggaacagcaccttcctgatcgacggccccgacacgtctgagtgtcccaacgagcgcagagcatggaacagcttcgaagtggaggactacgggttcggtatgttcacaaccaacatctggatgaagttccgggagggctccagcgaggtgtgcgaccaccggctcatgagtgctgccatcaaggatcaaaaggctgtgcacgcggacatggggtactggatcgaatcgagcaagaaccagacctggcaaatcgagagagcctctctgatcgaggtgaaaacgtgcctgtggcccaagacccacaccctgtggtcgaatggagtgctggagagccaaatgctgatccccaagtcctacgccggcccgttcagccagcacaactaccgacagggctacgcgacgcagacagtcggaccatggcacctcgggaaacttgagatcgactttggggagtgtcccggcacgaccgtgaccattcaagagaattgcgaccaccgggggccttccctgcgaaccacaaccgccagcggcaagctcgtgacccagtggtgctgccggagctgcaccatgccgccactgcgcttcctgggggaggatggctgctggtacgggatggaaatccggcccctctccgagaaggaggaaaacatggtcaagagccaggtaaccgcgggccagggcacctcagagaccttcagcatgggtctcctgtgcctaacactgttcgtcgaggaatgcctgcgccgccgcgtgacgcgtaagcacatgatcctcgccgttgtcatcactctgtgtgccatcattttgggaggtctcacctggatggacctgcttcgtgccctgattatgctgggcgacaccatgtccggccgcatcgggggccaaacgcacctcgcaatcatggcggttttcaaaatgagccccgggtacgtacttggagtattcctgcgcaaactgacatcccgggaaacggctttgatggtgattggcatggccatgaccacgaccttgagcatcccgcacgacctgatggaactcatcgacggtatctccttgggtttaatcctattaaagatcgtgacccagttcgacaacacacaggttgggacattggccctgtccctgacctttatccgtagcactatgtccttagtgatggcctggcggacgattatggcggtgctctttgtcgtgaccctcatccccttgtgccgtacctcctgtctccagaagcaaagccactgggtggagatcaccgccctgatcctgggcgcccaggccctccccgtttacctaatgacccttatgaagggggcgtccagacgttcatggcccctcaatgaaggaatcatggccgtgggactggtcagtctgttgggcagcgccctgttgaagaacgacgtcccgctcgccggccccatggtagcggggggcctgctgttggcggcctacgtgatgtccggcagcagcgccgatctgtccctagaaaaggccgcaaacgtccaatgggatgagatggccgacatcacgggcagctcgcctatcatcgaggtgaagcaggacgaagatgggagcttctccatacgtgacgtggaggagaccaatatgattaccctgttagtcaagctggcccttatcaccgtgagcgggctgtatcccttagccatcccaattacgatgaccctctggtacatgtggcaggtgaagacccagcgctctggcgccctgtgggacgtacccagccccaccgccacgcagaaggccgcgttgtccgagggggtctaccggatcatgcagcgcggcctcttcggaaagactcaggtgggtgtcgggattcacatggagggcgtgttccacaccatgtggcacgtgacccgtggcagtgtcatatgtcacgagaccgggcgactggagccctcctgggcagatgtgaggaacgatatgattagctacgggggagggtggcggctgggggacaagtgggacaaggaggaggatgtgcaggtattggctatcgagccgggtaaaaaccccaagcacgttcagacgaaacccggtctgttcaagacactgaccggcgagatcggcgccgtaaccctcgacttcaagccgggtacgagtggctctcccatcataaacaggaagggcaaggtgatcggtctgtacggcaacggggttgtgacaaaatccggcgactacgtcagcgcaatcacgcaggccgagcggattggtgaacccgactatgaggtggacgaggacatctttcgcaagaaacggctgacaatcatggacttgcaccccggcgccggcaagacaaagcgcatattgccctccatcgtacgggaggctctgaagcgccggctacgcacgttgatcctcgctcccactcgggtagtggcggcagagatggaggaggctctgcgagggcttcccatacgttatcagacgcccgccgtgaagagtgaacacacaggacgcgaaatcgtcgacctgatgtgccacgcgacgtttaccacccggctgttatcttctactcgcgtgccgaactataacctgatcgtaatggacgaagcccatttcaccgaccccagctccgtcgccgcgcgggggtatatcagcactcgcgtggagatgggggaggccgcggcaatctttatgaccgccacgccccctggagccaccgaccctttcccccagtccaacagccctatcgaagacatcgagcgggaaatccccgagcgcagctggaacaccggctttgactggatcaccgactaccagggcaagacggtatggttcgtgccgagtatcaaggccggaaacgacatcgcgaactgccttcgtaaatccggcaagaaggtaattcaactcagccggaaaaccttcgacactgagtaccccaagaccaaacttacggactgggacttcgttgtgaccacagacatctccgagatgggggccaacttccgcgccggccgggtaatcgaccccaggagatgcttgaagcccgtcatcctcaccgacgggccggagcgcgtaattctagccggaccgatccctgtgacgcccgcgagcgcagcccagcgccgcggcaggatagggcgcaacccggctcaagaagatgaccagtatgtcttctcaggcgaccccctgaagaacgacgaggaccacgcacactggaccgaggcgaaaatgctcttagacaatatctacacaccagagggtatcattccaacgctgttcggcccggagcgggagaagacacaggcaatcgatggcgaatttcgccttcggggggagcaacgcaaaaccttcgtcgaactgatgcggaggggtgacctccccgtgtggctcagctacaaggttgcctcggccgggatcagctacaaggatcgtgagtggtgtttcaccggggagcgcaacaaccagattttagaagagaacatggaagtagagatctggacccgggagggggagaagaaaaaattacgcccaaaatggctcgacgctcgcgtatatgcagaccccatggctctgaaggacttcaaggagttcgcatccggtcgcaagagcatcaccttggacatcctgacagaaatagcgtcgcttcccacgtatctgtcatcccgcgccaagttagcgttagacaacatcgtcatgctgcacaccaccgagaggggcgggcgcgcctaccagcacgccctcaacgagctgcccgagtcgctggagacactcatgctggtggccctgctcggggcgatgaccgccgggatttttctgttctttatgcagggtaaggggatcggcaagctgagcatgggcctcattaccatcgccgtcgcctccgggctcttgtgggtcgccgagattcagccgcagtggatcgcggctagcatcattttagagttcttcctaatggtgctgttaatcccggagcccgagaaacagcggaccccccaggacaaccaactgatctacgtgatcctgacaatcttaaccatcattggtcttattgccgccaacgagatgggtttaatcgaaaagactaagaccgacttcggcttctatcaggtgaagaccgagaccaccatcctcgatgtggacctgagaccagccagcgcgtggaccttatacgccgtcgccacgacaatcttaaccccgatgcttcggcacaccatcgagaacacgagcgccaacctgtccctcgccgcgatcgccaaccaagctgccattctgatggggcttggcaaaggctggcccctccatcgaatggacctgggggtccccctgttagcgatgggctgctacagccaggtgaaccccacgaccttgaccgcgtccctggtgatgctcctcgtccactacgccatcatcggacccggcctccaggccaaagccactcgggaggcgcagaagagaactgccgccggaatcatgaagaatcccaccgtggacgggatcaccgtcatcgacctcgaacccatcagctacgaccccaagttcgagaaacaactggggcaggtcatgctgcttgccttatgcgctgggcagcttctcctgatgcggacgacctgggcgttctgtgaggttctcactctcgccaccgggccgatactaacactgtgggagggcaaccccggacgcttctggaatacaaccattgccgtgtctaccgcaaacatattccgagggtcctacctggcaggcgcgggcctcgcattctccctgatcaagaatgcccagacccctagacggggtactggcactacaggggagaccctcggtgagaaatggaagcgccaactgaacagccttgaccggaaggagttcgaagagtacaagcgctcgggtatactcgaggtcgaccggacggaggcaaagtcggccctgaaagacggctccaagatcaagcacgcggtgagccgcggcagcagtaagatacggtggatcgtggagagagggatggtcaaacctaagggcaaggtggtcgacctggggtgtggccgcggagggtggtcttattatatggcaaccctcaagaacgtcaccgaggtgaagggctataccaaggggggtcctgggcacgaggagcccatccccatggcaacgtatggctggaacctggtaaagctgcatagcggcgtcgatgtgttttataagcccaccgagcaggtcgacaccctcctgtgtgacatcggggaaagctccagcaaccccaccatcgaagagggccgcacgctgcgtgtacttaaaatggtcgagccctggctatccagcaagccagagttttgcatcaaggttctaaacccctacatgccgaccgtcatcgaagagttggaaaagctccaacggaagcatgggggcaacctggtgcgctgccccttaagtcggaacagcacccacgaaatgtattgggtgtccggggccagcggtaacattgtctccagtgttaacaccacctccaaaatgctcctgaaccgcttcacgacccggcacagaaagcccacctatgagaaggacgtcgaccttggcgcagggacccggtctgtttccacagagaccgagaagccagacatgaccatcatcgggcgcaggctccagcgcctgcaagaagagcacaaagagacgtggcactacgaccaggagaacccgtaccggacgtgggcgtaccacgggagctacgaggccccctcgaccggcagcgccagctctatggtgaacggagtcgtcaagctgctaaccaagccctgggacgtaatcccgatggtcactcagctggccatgacagacactaccccctttggccagcagagagtgttcaaagaaaaggtcgacacgcggacaccccagcctaagccgggaacccgcatggtcatgaccacgactgcgaattggctctgggcactcctgggtaagaaaaagaaccctcggttatgcaccagggaggagtttatctccaaggtgcgaagcaacgccgctattggcgcggtgttccaagaggagcaggggtggaccagcgcttcggaggccgttaacgatagccgcttctgggagctggtggacaaggagcgggccctgcaccaggaaggcaagtgcgagtcctgcgtgtataacatgatgggtaagcgcgagaaaaagctgggagagtttggccgcgctaaggggagcagggcgatctggtacatgtggctcggcgcgcgtttcctcgagttcgaagccctcgggttccttaacgaggatcactggttcggtagagaaaattcctggagtggtgtcgagggagagggcctgcaccgcctcgggtacatccttgaggaaatcgacaaaaaggacggtgacctgatgtatgcggacgatacggccggttgggacacccgtataacagaggacgacctgcagaacgaggaactcatcaccgagcagatggcgccccatcacaaaatcctggccaaagcaatcttcaaactgacctaccaaaacaaggttgtgaaggtgctccgccccactccgcgtggggccgtcatggacattatcagtcgcaaggaccagcggggctctggccaggtaggcacctacgggctgaatacgttcaccaatatggaggttcaactaatccgccaaatggaggccgagggcgtaatcacgcaggacgacatgcagaaccccaagggcttgaaagaacgagtggagaagtggctgcgggaatgcggggtggacagattgaagcgtatggccatctccggcgacgactgcgtggtgaagcccctagacgaacggtttggtaccagcctgctgtttttgaacgacatgggcaaggttcgcaaggacataccccaatgggagccatctaaggggtggaagaactggcaggaggttcccttctgcagccaccacttccacaagatcttcatgaaagacggccggtcgctcgtggtaccctgcagaaaccaagatgaactgataggtcgggcccgaatctcacaaggggccggttggagtctccgtgagaccgcctgcctggggaaggcatacgctcagatgtggagcctcatgtattttcatagaagggacctgcggctggccagcatggccatctgcagcgccgtgcccactgaatggttcccgacgagccgaaccacctggtccatccacgcccaccatcagtggatgaccaccgaagacatgctgaaggtctggaatcgggtctggatcgaggacaaccccaacatgatcgacaaaacccccgtgcactcttgggaagacatcccctacttgggcaagcgcgaggacctgtggtgcggatccctgatcggcctgagcagtcgggcgacctgggcaaaaaacatccatactgcgataacacaggtgcgtaacctgatcggcaaagaagagtacgtggactacatgccagttatgaagcggtacagcgcacccagtgaatcggagggggtgctgtaa

SEQ ID NO: 26340 - RNA, 9867 nt, synthetic construct
  misc_feature 1..9867: note = derived and/or modified CDS sequence (opt11) from DENV-4__HQ332176__SS-prME
  source 1..9867: mol_type = other RNA
tcaaccatcaccctgttgtgcctgatacccactgtgatggccttccacctgtccacgagggacggcgaacctttaatgatcgtcgcccggcacgaacgcgggcgccccctgttattcaagaccacggaagggatcaacaaatgtacgctcatcgcgatggacctgggtgagatgtgcgaagacaccgtgacctacaagtgcccccttctcgtgaacaccgagcccgaggacatcgactgttggtgcaacctgacgtccacctgggtcatgtatgggacctgcacccagagcggcgagcgacggcgggagaagcggagcgttgctctgacgccgcactccggcatgggccttgagacgcgcgcggagacttggatgagctccgagggggcctggaagcatgcccagcgggtggagagctggatccttcgcaatcccgggttcgctctgcttgcagggttcatggcctacatgatcggccagacgggtattcagcgcacggtgttcttcgtcctcatgatgctggtggccccgtcctacggcatgcgctgcgtcggggttgggaaccgggacttcgtggagggcgtaagcgggggtgcatgggtggacctcgtgctggagcacggcgggtgtgtgaccaccatggcgcagggcaaacccaccctggacttcgagttgaccaagaccaccgccaaggaggtggctctgttacggacctactgcattgaggccctcatatccaacatcacgaccgcgacccggtgcccgacccagggggagccctacctaaaggaggagcaggaccaacagtacatctgccgccgggacgtggtcgatcgcggctgggggaacgggtgcggcctttttgggaagggcggtgtagttacctgcgctaaattcagctgctccggtaaaataaccgggaaccttgtccagatcgaaaacctggaatacaccgtggtggtgaccgtgcataacggtgacacgcacgccgtcggcaacgacacgagcaaccacggcgtgaccgccaccataacgccccggagtccgagcgtggaggtcaagctgccggactacggcgaattgaccctcgattgcgagccccgctccgggatcgacttcaacgagatgatactcatgaagatgaagaagaagacctggctcgtccataagcagtggtttctggacctgcccctcccctggaccaccggtgccgacacgtcagaggtgcactggaactataaggagcggatggtgaccttcaaggtgccgcacgcgaagcgccaggacgtgacagtcctggggagccaagagggggcgatgcacagcgccctggcgggcgccacagaggtggacagcggggacggaaaccacatgtttgctggccacctcaaatgcaaggtccgcatggagaagctgcggatcaagggcatgtcctacacgatgtgtagcggcaagttcagcatcgacaaagagatggccgaaacccagcacggcaccaccgtcgtcaaggtaaagtacgaaggcgctggagcgccctgcaaggtcccaattgagatccgcgacgtgaacaaggagaaagtggtcggacgggtgatcagcgccacgccactggcggagaacacaaactccgtgacgaacatagagttggagccgccgttcggggactcatacatcgtcatcggcgtgggcaactccgctctgactctgcactggttccgtaaggggagctccataggcaagatgttcgaaagtacgtatcgcggggctaagcgcatggccattctcggcgagaccgcatgggacttcgggtccgtgggcggcctgttcacctccctcggtaaggccgttcaccaggtgtttggctccgtgtacaccactatgttcggtggcgtctcctggatgatccgaatcctcatcgggtttttagtgctgtggatcggcaccaactcgcgcaacaccagcatggccatgacatgcatcgccgtgggcgggataacgctgttcttgggcttcacagtccaggccgacatgggttgcgtggtttcctggagcggtcgcgagctgaagtgtggatccggaatcttcgttgtagacaacgtccatacctggaccgagcagtacaagttccagcccgagagtcccgctcggctggccagcgctatcctcaatgcccacaaggacggcgtgtgcgggatccgatccacgaccagactggagaacgtgatgtggaagcaaatcactaacgaactaaattacgtgttatgggaaggcgggcatgacctgacggtcgtggccggcgacgtgaagggcgtcctcacgaaggggaagcgggctttgaccccgccagccagcgacctgaagtactcctggaagacttggggtaaggccaagatcttcacacctgaggcccggaacagcacattcctaatcgacgggcctgacacctccgaatgtccgaatgagcggcgcgcctggaatagcttcgaagtggaggactacggcttcgggatgttcaccacaaatatctggatgaagttccgggagggctccagtgaggtgtgcgaccaccgcctcatgtccgcggcaatcaaggaccagaaggccgtccacgccgacatgggctactggatagagagctccaagaatcaaacatggcagatcgagcgggcgagcctgatcgaggtgaagacgtgcctgtggccgaagacccacacactctggtccaacggcgtgctggagagccagatgcttataccgaagtcctacgccgggccgttcagccagcacaactacagacagggctatgccacccaaacggtcggtccgtggcacctcggaaaacttgagatcgatttcggcgagtgccccggcaccacggtcaccatccaggagaactgcgaccaccgcgggccctccttgcggacgaccaccgccagcggcaagctcgtcacccagtggtgctgtcgcagctgcacgatgccgcccctgcgtttcctgggtgaggacggctgctggtatgggatggagatccgccccctcagtgagaaggaggagaacatggtcaaaagtcaggtgaccgccggccagggcacctccgagaccttcagtatgggtctgctgtgcctcacactgtttgtggaagagtgcctgcggaggcgagtgacccgcaaacacatgatcctcgcggtggtcatcaccctgtgcgccatcattttgggtggcctcacctggatggacctgctgcgggcccttatcatgttaggcgacacgatgtccggccggatcggagggcaaacccacctggccatcatggccgtatttaagatgtcccctgggtatgtgctcggcgtcttcctgcggaagctgacctcccgcgagaccgcgctcatggtgatcgggatggccatgacgaccaccctgagtataccgcacgacctgatggagttgatcgacggtatctccctggggctgatactcctcaagatcgtgacccaattcgacaacacgcaggtcgggacgcttgccctctcacttacctttatcagatctaccatgagcctggttatggcctggcgcacgatcatggcggtactcttcgtggtaaccctgatccccttgtgccgaacttcctgcctccagaagcaaagccactgggtcgagatcaccgcgttaatcctgggagcccaggccctaccggtctacctgatgacactgatgaagggggcgtcccggagatcttggcccctcaacgagggcatcatggcggtggggctggtctccctgctcggcagcgccctgctgaagaacgacgtgcctctcgccggccccatggtggctggtggcctgctgctcgccgcgtacgtgatgtccgggagctcagccgacctgtccctggagaaggccgcgaacgtccagtgggacgagatggctgacattaccggctcgtccccgatcatcgaggtgaagcaggacgaagacgggagcttctccatccgcgacgtagaagagactaacatgatcaccctcctggtcaagctggcgcttatcacagtatcgggcctataccctctggccatcccgatcaccatgaccctctggtacatgtggcaagtgaagacccagaggtccggcgcactgtgggacgttcctagccccgccgccactcaaaaggcggccctgtccgagggggtgtaccgcatcatgcaacggggcctcttcgggaagacacaggtgggcgtcgggatccacatggagggcgtgttccacactatgtggcacgtgacccgtggtagcgtcatttgccacgagacagggaggctggagccctcctgggccgacgtgcggaacgacatgatcagctacggagggggctggcgtctgggcgacaaatgggacaaggaggaggatgtgcaggtcctcgccatcgagccggggaagaaccccaagcacgtgcagacgaagcccggactgttcaagacgctgaccggggagataggcgccgtgaccctcgattttaagcccgggacatccggtagccccatcatcaatcgaaagggcaaggtcatcgggctgtacggcaacggggtggttaccaagtccggagactacgtaagcgcgatcacccaggccgagcgcatcggggaaccggactacgaggtggacgaggacatcttccgcaagaagcgactaaccatcatggacctccatcccggcgcaggcaagactaagcggatcctgcctagtatcgtgagggaggctctgaagcggcgcctgaggaccctcatactcgcgcccacccgcgtcgtggcagcagagatggaggaagccctgcggggtctccccatccgctaccaaacccccgctgttaaaagcgagcacacgggccgggagatagtagatctcatgtgtcatgcgacgttcactacccgcttactctcctcaacgcgggtgccgaactacaacctgattgtgatggatgaggctcacttcacggaccccagctccgtagccgcccgggggtacatctcgacccgggtagagatgggcgaggccgctgccatctttatgacagcaacaccccctggagctaccgacccgttcccccagtccaatagcccaatcgaggacatcgagagagagatccccgaacgctcctggaacaccgggtttgactggatcactgactaccagggcaagacggtgtggttcgttccgagcatcaaggccgggaatgacatcgcaaactgcctgcggaagtccggcaagaaggtgatccagctcagcagaaagaccttcgacaccgaataccccaagaccaagctgacagactgggacttcgtcgtcaccaccgatatctcagaaatgggcgccaatttccgggcgggtcgcgtgatcgacccgcggcgctgcctgaagcccgtcatactaaccgacgggccggagcgggtcatcctggccgggcccatccccgtcacgcccgcgagtgccgctcagcgtcggggccgcatcgggcggaacccggctcaggaggacgaccaatacgtcttctcgggagacccactcaagaacgatgaggaccacgcccattggaccgaggcgaaaatgctcctcgacaacatctacacccccgaggggatcatcccaacactgttcggccctgagcgtgagaagacgcaggcgattgacggcgagttccggctccgcggcgagcagcggaaaaccttcgtggaactgatgcgccggggtgaccttcccgtctggctgagttataaggtcgcctccgcgggaatcagctataaggatcgcgagtggtgctttaccggcgaacggaataaccaaatcctggaggaaaacatggaggtggagatctggacccgcgagggggagaagaagaagttgagacccaaatggctcgacgcccgcgtgtacgctgaccccatggctttgaaggacttcaaggagttcgcatccggccgcaagagcattaccctggacatcctaactgagatcgcctccctgccaacctacctgtcttccagagcgaaacttgcgctcgacaatatagtgatgctgcataccacggaaaggggcgggagggcctaccagcacgccctcaacgagctgcctgagagcctggagacgctcatgcttgtggccctgctcggcgcgatgaccgccgggatcttcctgttctttatgcagggtaaggggattggaaagctgagtatgggcttaataaccatcgccgtagccagtgggcttctctgggtggccgagatccagccccagtggatcgcggccagcatcatcctcgagttcttcctgatggtgctgttaattccggagcccgagaagcaacgtacaccccaggataaccagctgatctacgtcatcctcacgatcctcacaatcatcggcctgatcgccgccaacgagatggggctgatcgagaagaccaagaccgactttggcttctaccaggtcaagacggagaccaccatcctcgacgtggaccttcggcccgcctcggcttggaccttatacgccgtggccacgaccatcctcaccccgatgttacgtcacacgatcgagaacacctcggcaaacctctccctcgccgcgatagccaaccaagccgccgtcctgatgggacttggcaagggctggcccctccatcggatggatctgggggtaccccttctcgcaatgggctgctacagccaggttaaccccaccacgcttaccgcgtccttagtcatgctcctcgtgcactacgccataataggcccgggcctgcaagcaaaggccacccgcgaagcgcagaagcggacggccgctggcatcatgaagaaccccaccgtggacgggatcaccgtcatcgacctcgaacccatctcttacgaccccaaatttgagaagcaactgggccaggtgatgctgctcgtactgtgcgctgggcagctgttacttatgcgaacgacatgggccttctgcgaagtcttgacccttgcgaccggaccgatcctgacgctgtgggagggtaaccccggccggttctggaacactacaatcgccgtgtccaccgccaacatcttccgcggcagctacctcgctggggccggcctggcattctcccttatcaagaacgcccagacgccccggagggggaccggtaccactggggagaccctcggcgagaaatggaaacgccagttaaacagcttagaccgcaaggagttcgaggagtacaagcggtccggcatcctcgaggtggatcgcacggaggcaaagagcgcgctaaaggacgggtccaaaataaagcacgccgtgagccgtggttccagcaagatccgctggatcgttgagcgtgggatggtgaagccgaagggaaaggtcgtggacctgggctgcggacggggagggtggtcctattacatggcgactttgaagaacgtgacagaggtcaagggctacaccaaaggaggcccggggcacgaggagcccatcccgatggcaacgtacgggtggaacctggtgaagctgcattctggcgtggacgtattttacaagcctaccgagcaggtcgacacactcctgtgtgacatcggggagagcagctctaaccccacgatcgaggagggccgcacactgcgggtgctcaagatggtcgagccctggctgtccagtaagcccgagttctgcatcaaggtgcttaatccctacatgccgaccgtgatcgaggagcttgaaaagctccaacgcaagcacgggggcaacctggtccggtgccccctgtcccggaacagcacccacgagatgtactgggtgagtggggcctcggggaacatcgtaagttctgtgaacacgacgtccaagatgctcctgaaccgattcaccacccgacaccgcaagcccagctacgaaaaggacgtggacctgggcgctgggacccgcagtgtcagcactgagaccgagaaacccgacatgacaatcatcggccggcgcctacagcggctgcaggaggagcacaaggagacctggcactacgaccaggagaacccctaccgcacttgggcgtaccatgggagctacgaggccccctccaccggctcagctagctccatggtgaacggcgtggtcaagctgctcactaagccctgggatgtgatccctatggtgacccaactggccatgacggatacaacccccttcgggcagcagcgggttttcaaggagaaagtggacacccgcacgccccagcccaagccgggcacccggatggtgatgaccaccacggccaactggctgtgggcgctcttggggaagaagaagaatccccgcctgtgcacacgggaggagttcatcagcaaagtccggtcaaacgccgccatcggcgctgtgttccaagaggagcaggggtggacctcggcgagcgaggctgtgaacgattcccggttctgggagttagtcgacaaggaacgcgccctacaccaggagggtaagtgcgagtcctgtgtgtacaacatgatgggcaagcgcgagaagaagctgggagagttcggccgggccaaggggagccgggctatctggtacatgtggcttggggcccggttcctggagttcgaagcgctaggctttctcaacgaggaccattggttcggcagagagaatagctggtccggcgtggagggggaaggtctgcaccggctgggatacattctcgaggagattgacaagaaagacggcgacctgatgtacgcggacgacaccgcaggctgggacacccgcattacggaggacgatctacagaacgaggagctcatcaccgagcagatggcaccccaccacaagatcttagcgaaggccattttcaagctgacttaccagaacaaggtcgtaaaggtgctccggccgaccccgagaggggccgtcatggacatcatcagccggaaggaccagcgcggatcggggcaggtcggcacgtacggtctgaacactttcacgaacatggaggtgcagctgatccggcagatggaggccgagggggtcatcacccaggacgatatgcagaacccaaagggcctcaaagagcgcgtggagaagtggctgcgggagtgcggggtggaccgcctgaagcggatggccataagcggcgacgactgcgtcgtgaagcccctcgacgagcgcttcgggacctcgctgttgttcctcaatgacatgggcaaagttaggaaggacatcccacagtgggagccgagcaagggttggaaaaactggcaggaggtgcccttctgctcgcaccacttccacaagatttttatgaaagacggccgcagcctggtggtgccgtgtcgcaatcaggacgagctgattggccgcgcgcgcatatcacagggggcgggctggagcctccgggagaccgcgtgtctgggaaaggcctatgcccagatgtggtcgctcatgtacttccaccgaagagaccttagactggctagcatggctatctgcagcgccgtcccgactgagtggtttccgacctcccggactacctggagcattcacgcacaccaccagtggatgaccacggaggatatgctgaaagtgtggaatagagtatggatcgaggacaaccccaacatgatagacaagacgcccgtccactcctgggaggacatcccctacctcggcaagcgggaagacctgtggtgtgggagcctaattggcctctccagccgcgccacctgggcgaaaaacatccacaccgccatcacccaggtcaggaacctgatcggcaaggaggagtacgtcgactatatgccggtcatgaagcgctactccgcccctagcgagtcagagggggtgttatga

SEQ ID NO: 26341 - RNA, 9867 nt, synthetic construct
  misc_feature 1..9867: note = derived and/or modified CDS sequence (opt11) from DENV-4__HQ332174__SS-prME
  source 1..9867: mol_type = other RNA
tcgacgatcacgctactctgcctgattcccaccgcgatggccttccatctgtccacccgggacggcgagcccctcatgatcgtggcgaagcacgagcgggggcgccccctgctgttcaagactaccgaaggaattaacaagtgcaccctcatcgccatggatctgggggagatgtgcgaggacactgtgacctataagtgccccctgttagtgaacaccgagcccgaggacatcgactgctggtgcaacctcacgagcacctgggtgatgtatgggacctgcacccagtccggggagcggcgccgggagaagcgcagcgtggccctcacgccccacagtggcatgggcttagagacccgggccgagacctggatgagctccgagggggcctggaagcacgcccagagagtggagtcgtggatcctgcggaaccccggcttcgcactgctcgccgggttcatggcttatatgatcggccagaccgggatccagcgcacggtgttcttcgttctgatgatgctagtggcgccctcatacggcatgcggtgcgttggcgtcgggaaccgcgatttcgtggagggcgtgagcgggggcgcgtgggtcgacctcgtgctggagcacggcgggtgcgtgaccaccatggcccagggcaagcccacgctggatttcgagctcacgaaaaccaccgctaaggaggtggccctcctgcgtacatactgcatcgaggcgctcatcagtaacataacgacggccacccgctgcccaacccaaggggagccctacctgaaagaggagcaggaccagcagtacatctgccggcgagacgtggtggaccggggctgggggaacggctgcgggctgttcgggaaaggcggagttgtgacgtgcgctaaattcagctgctccggcaagatcaccggtaacctcgtgcagatcgagaacttggagtacaccgttgtggtgaccgtccacaacggcgatacccacgccgtaggcaacgacaccagcaaccacggggtcacagccaccatcacgccccgctcaccgagcgtggaggtaaagctgccggattacggggagctcaccctggactgcgagcccagatccggcatcgacttcaacgagatgatccttatgaagatgaagaagaagacctggctcgtccacaagcagtggttcctggatctgcccctcccctggaccacgggcgcggacaccagcgaagttcattggaactacaaagaacgcatggtgaccttcaaggtcccgcacgctaagcggcaggacgtgaccgtgttggggtcccaggagggcgccatgcacagcgccctagccggagcgaccgaggtggacagcggagacggcaaccacatgttcgcagggcacctcaagtgcaaggtgcgcatggagaagctgagaataaagggcatgtcctataccatgtgcagcggcaagttcagcatcgataaagagatggcagagacccagcacgggactacagtggtaaaggttaagtacgagggcgccggggcgccgtgcaaggtgccaatcgagatccgggacgtcaacaaagagaaggtggtgggccgcgtcatcagcgcgacgcccctggccgagaataccaactccgtaaccaacatcgagctcgagccgccttttggggacagctacatcgtaatcggcgtcggcaattccgccctgacactgcattggttcaggaaggggagctccatcggtaagatgttcgagagtacgtatcgcggggccaagcggatggcgatcctcggcgagaccgcatgggacttcgggtctgtgggcggcctcttcaccagccttgggaaggcggtgcaccaggttttcgggtccgtgtatacaacgatgttcggcggggtgagctggatgatccgaatcctcatcgggtttctggtcctgtggatcggtaccaactcccggaacaccagcatggccatgacgtgcatcgccgtgggggggatcacactatttctcggattcaccgtgcaggcggacatggggtgcgtcgtgtcctggagtgggagagagctgaagtgcgggtccggcatcttcgtggtcgataacgtgcacacctggaccgaacagtacaagttccaacccgagagccccgcgcggctggccagcgccattttgaacgcccacaaggatggcgtgtgcgggatccgtagcacgacccggctggagaacgtcatgtggaagcaaattaccaacgaactgaactacgtactctgggaaggcggccacgacctgacggttgtcgcaggcgacgtaaagggcgtgctgacgaaggggaagcgcgctctcacgccgcccgccagcgacctgaagtactcttggaagacctggggcaaggcaaagatcttcactcccgaggccaggaattcgacgttcctgatcgacggacccgatacctccgagtgcccgaacgagcgccgcgcgtggaacagcttcgaagtcgaagactacggcttcgggatgtttacgaccaacatctggatgaagtttcgcgaaggctcgagcgaagtttgtgaccaccggctcatgtccgccgccattaaagaccagaaagccgtgcacgcggacatgggttactggatcgagtcctccaagaaccagacgtggcagatcgagcgcgcgagcctgatcgaggtgaagacatgcctgtggccgaagacccacaccctctggtccaacggtgtgctggagtcacaaatgttaatccccaagtcctatgccggcccgttctcgcagcacaattaccggcaggggtatgccacccagacgatgggaccctggcatctcgggaagttggaaatcgacttcggcgagtgccctgggaccaccgtgaccatccaagagaactgcgaccaccgggggccctccctgcgcacgaccactgcctcaggcaaactcgtcacccagtggtgctgtcggagctgcacgatgccgcccctgcgcttcttgggggaggacggctgctggtatggtatggagatccgcccactctcagagaaggaggagaacatggtcaagagccaggtgactgcgggccagggcgcctccgaaacctttagcatggggctgctgtgcctcacgctgttcgtcgaggagtgccttcgtcggcgagtgacgcggaaacacatgatcctcgccgtcgtgatcaccctgtgcgccatcatcctgggtggcctcacctggatggatctgcttcgcgccctgatcatgctgggcgatactatgtccggtcggatcgggggccagacgcatctggcaataatggccgtgttcaagatgagccccgggtacgtgctgggcgtgttcctgagaaagctgacctcccgggagaccgccctcatggtgatcggcatggccatgaccactaccctgagcatcccacacgacctgatggagctcatcgatggcatctctctggggttaatcctcctgaagatcgtcacccagtttgacaatacgcaggtggggacgctggccctcagcttaaccttcatcaggtccaccatgagcctggtgatggcgtggcggaccattatggccgtacttttcgtagtgacgttgatccccctgtgccgcacctcctgcctccagaaacagagccactgggtcgagatcaccgccctgatcctgggcgcccaggcgctccccgtgtaccttatgaccttaatgaagggggcctctcggagaagctggcccctcaacgaaggcatcatggccgtggggttagtctccctgctcggttctgcgctgctgaaaaatgacgtcccgctcgccggccccatggtggcgggcggcctcctgctagccgcctatgtcatgtccgggtcgagcgccgacctgtccctagagaaggccgcgaacgttcagtgggacgagatggccgacatcacagggagctccccaatcatcgaggtgaaacaagacgaggatgggagcttctccatccgggacgtagaggagaccaacatgatcacactcctggtgaagctggcattaattaccgtgtcaggcctgtaccccctggccatcccaatcaccatgaccctttggtacatgtggcaggttaagacccagcgctcaggcgccttgtgggacgtgcccagccccgcggccacccagaaggcggccctgtcggagggggtgtacaggatcatgcagcgcgggctcttcgggaagacacaagttggcgtggggattcacatggaaggggtattccacaccatgtggcacgtcacccggggcagcgtgatctgccacgagaccgggcgcctggaaccgtcctgggcggacgtgcgcaacgacatgataagctacggaggcgggtggcggttaggagacaagtgggacaaggaggaggacgtccaggtgctcgcgatcgagccggggaaaaaccccaagcacgtgcaaaccaaacccggcctgttcaagacgctgaccggggagatcggcgccgtcactctcgattttaagcccggcacatccggcagccccattatcaatcgcaaggggaaagtgataggactgtacggcaatggggtcgttacgaaatccggagactacgtgtctgctatcactcaggccgagcggatcggggagcccgactatgaggtagacgaggatatcttcagaaagaagcggctgaccatcatggatctccaccccggcgcgggcaagaccaaacgcatcctgccctccatcgtgcgggaggccctgaaacgccggctgcgcacactaatcctggcccccacccgggttgtggccgccgagatggaggaggctctgagagggctccccatccggtaccaaaccccagccgtaaagagcgagcacaccggccgcgagatcgtggacctgatgtgccacgccacgttcaccacccggctgctctcaagcacccgcgtgccaaactacaacctgatcgtcatggatgaggcccacttcacggaccccagctccgtagccgcgcgggggtacatcagcacccgcgtcgagatgggtgaggccgccgccatcttcatgaccgccacaccccccggggccacggacccgttcccccaatccaactcccccatcgaagacatcgagcgggagatccccgagaggagttggaacaccggcttcgattggatcacggactatcagggcaagaccgtctggttcgtgccaagcatcaaggccggcaatgacatcgccaactgtctgcgcaagtccggcaagaaggtgatccagttaagccggaagaccttcgacaccgagtacccgaagaccaagctgaccgactgggatttcgtggtgacgactgacatttccgagatgggggctaacttccgcgcgggccgcgtcatcgacccccgccggtgcctgaaacctgtgatcttgaccgacgggccggagcgcgtgattctggccggccccattccggtcacccccgccagcgccgcccagcggcgcggcagaatcgggcgtaatccggcgcaggaggacgaccagtacgtcttctccggcgaccccctgaagaacgacgaggaccacgcccactggacggaggccaagatgttgttggacaacatctacacccccgaggggatcatccccacgttgttcggccccgagcgggagaagacccaggccattgacggggagttccgcctccgcggtgagcagcgcaaaacgttcgtggagctgatgcggcgcggcgacctgccagtctggctgagctacaaggtggcctccgccggcattagctacaaggatcgtgaatggtgtttcaccggcgaacgcaacaatcagatcctggaggagaacatggaggttgagatctggacccgggaaggggagaaaaaaaagctgcgtcccaagtggctcgacgctcgggtctatgccgaccccatggctctgaaggacttcaaggagttcgcctcaggccgcaagagcatcaccctggacatactcaccgagatcgcgtctctgccgacgtacctgagcagtcgcgccaagctggcactggataacatcgttatgctgcacaccacggaacggggcgggcgcgcctaccaacatgcgttaaacgaacttcccgagagcctggagaccctcatgctggtggccctgctcggcgccatgaccgccgggatattcctgttcttcatgcagggcaaggggatcggcaagctgtcaatgggtctcatcactatcgccgtcgcatccggcctcctgtgggttgctgagatccagccgcagtggatcgctgccagcattatcctcgagttcttcctgatggtgctgctcatcccggagcccgagaagcagcgcacgccacaggacaaccagctgatctacgtcatcctgaccatcctaacgataataggccttatagccgcgaacgaaatgggtttaatcgagaagaccaagaccgatttcggcttttaccaggcgaagactgaaacgaccatactcgacgtggacctgcgacccgcctccgcctggaccttgtacgccgttgcgaccacgatcctcaccccgatgttacggcacacaatcgagaacaccagcgccaacctgtccctcgccgctatcgccaaccaggcggccgttctgatgggactgggtaagggatggccactccatcgcatggacctgggggtgcctctgctcgccatgggctgctattctcaggtgaatcccacgaccttgaccgcctcattagtcatgctcctggtgcactacgcaataatcgggccgggcctgcaagccaaagccacccgggaagcccaaaagcgcacggccgcgggcatcatgaagaaccccaccgttgacgggatcaccgtcattgacctcgaacctatcagctacgaccccaaatttgaaaagcagctgggccaggtgatgctgttagtgctctgcgccgggcagctgcttttgatgcggactacttgggccttctgcgaggtcctgacactcgcgaccggcccgatcctaactctgtgggaggggaacccgggccgcttctggaacactaccatcgccgtgtccaccgcgaacatcttccggggctcctacttggccggtgccggcctggccttctccctgattaagaacgcccaaaccccccggcggggtacgggcacaacaggggagacgctcggtgagaagtggaagcgccaactgaacagcttagacagaaaggagttcgaggagtacaagcgctcaggcatcctcgaggtcgaccggaccgaagccaagagcgccctgaaggacgggagtaagataaagcatgccgtcagccgcggctcatctaagatccgctggatcgtagagcgcggcatggtgaagcccaagggaaaggtcgtggatctggggtgcggccgcggcgggtggtcgtactacatggccacgttgaaaaacgtgacagaggtcaagggctacaccaaaggaggcccggggcacgaggagcccatcccaatggcgacctacggctggaacctggtgaagctgcacagtggcgtggacgtcttttacaagcccactgagcaggtcgacaccctcctgtgcgatatcggggagagttccagcaacccgaccatagaggagggccgaaccctgcgcgtgctcaagatggtcgaaccctggttatccagcaagcccgagttctgcatcaaggttctgaacccctacatgccgacggtcatagaagagctcgagaagctccagcggaagcatgggggcaacttggtccgctgccccctgtcccggaatagcacccacgagatgtactgggtgtccggagcgagcggcaacatcgtgtcgagcgtaaacaccacttccaagatgctcctgaacagattcacgacccggcaccgcaagcccacctatgagaaggacgtggacctgggtgccgggacgcggagcgttagcacggaaacggagaaacccgacatgaccatcatcggcaggcggctccagcgcctgcaggaggagcacaaggagacctggcactatgaccaggagaacccgtaccggacgtgggcgtaccatggatcatacgaggcaccctccaccggctccgcgtccagtatggtgaacggggtggtcaagctgctcacgaagccctgggacgtgatccctatggtgacccagctagcgatgacagacaccacccccttcggtcagcagagggtcttcaaggagaaggtggataccagaacgccgcagccaaagccgggcacccgcaccgtgatgacgacgaccgcgaactggctgtgggccctcctggggaagaagaaaaacccccggctgtgcacccgcgaggagttcatctctaaggtgcggagcaacgctgcgatcggggccgtgttccaggaagagcaggggtggacgagcgcctcagaagcagtgaacgacagccgtttctgggagctcgtcgataaggagagggccctacaccaggagggcaagtgcgaatcctgcgtctacaacatgatgggtaaaagggagaagaagttaggtgagttcggccgggccaagggtagccgcgcgatctggtatatgtggctcggcgcccgcttcctcgagttcgaggccctgggattcctaaacgaagaccactggttcggacgggagaactcctggagcggcgtggagggggagggcctgcaccggctggggtatatattagaagagatcgacaagaaggacggcgacctgatgtacgcagatgacactgccggatgggatactcggatcactgaggacgacctgcagaatgaagagctcatcaccgagcaaatggcgccacaccacaagatcctggccaaggccatcttcaagttgacctaccagaacaaggtcgtgaaggtgctccgccccacgccgcgcggtgctgtcatggacatcatatcccgcaaggaccagcggggcagcggccaggtgggcacctatggcctgaacacgttcaccaatatggaggtgcagctcatccgccaaatggaggccgagggtgtcataacgcaggacgacatgcagaaccccaaaggcctcaaggagcgggtggagaagtggcttcgcgagtgcggggtggaccggctgaagcgcatggctatatccggcgacgattgtgtcgtgaagcccctcgacgagcggttcggtacaagcctgctattcctcaacgacatgggcaaagtacgaaaagacatcccccagtgggagccgtcaaaggggtggaagaactggcaagaagtcccgttctgcagccaccacttccacaaaattttcatgaaggacggccgctccctggtggtgccctgccgcaatcaagacgaactgatcggccgggcgcgcatcagccagggggccggctggagcttgcgagagaccgcatgcctggggaaggcttacgcacagatgtggagcctgatgtactttcaccggcgagacctccggctggcctccatggcaatctgcagcgcggtccccactgagtggttcccgacgagccgcaccacctggtccatccatgcccaccaccaatggatgaccacggaggacatgctgaaggtgtggaacagggtttggatcgaggacaaccccaacatgatcgacaagaccccggttcactcttgggaggacattccctacctcgggaaacgagaggacctgtggtgcggttccctgataggcctcagctcccgagctacctgggccaagaacatccacaccgctatcacacaggtgcgcaacctaattggcaaggaggagtacgtggactacatgccggtcatgaagaggtacagcgcgccctccgagagcgaaggggtgctgtga

SEQ ID NO: 26342 - RNA, 9867 nt, synthetic construct
  misc_feature 1..9867: note = derived and/or modified CDS sequence (opt11) from DENV-4__KT026308__SS-prME
  source 1..9867: mol_type = other RNA
tccactatcaccttactctgcttaatccccactgttatggccttccacctgtccacccgtgacggcgaaccgctcatgatcgtcgccaagcacgaacgggggcgccctctgctgttcaagacgaccgagggcatcaacaagtgcactcttatcgcgatggacctgggggagatgtgcgaggacacggtgacctataagtgccccctattagtgaacaccgaacccgaggacattgactgctggtgtaatctcacgtcgacatgggtcatgtacggcacctgtacccagagcggggagcggcgccgggagaagaggagcgtcgccctgacgccgcactccggcatgggcctcgagacccgggccgagacctggatgtcctccgagggggcctggaagcacgcccagcgcgtggagtcgtggatcctgcggaaccccggcttcgcgctgctcgccggattcatggcctacatgatcggccaaaccgggatccagcgcacggtcttcttcatcctgatgatgctggtggccccctcttacggcatgcggtgcgtgggcgtcgggaaccgcgactttgtcgaaggcgtgagcgggggagcgtgggtcgacctagttttggaacacggcggttgcgtgactaccatggcccagggcaagcctaccctagacttcgagttaatcaagacgacggccaaggaggtcgcattactgcggacctactgtattgaggcctccataagcaacataaccacggcgacccgctgcccgactcagggggaaccgtacctcaaggaggagcaggatcagcagtacatctgccggcgcgacatggtggaccggggctgggggaacggatgtggcctcttcgggaaaggcggggtagtaacctgcgccaagttttcctgcctgggcaagatcacggggaatctagtccaaatcgagaatctggagtacaccgtggtagtcacggttcataacggcgacacccacgccgttggcaacgacacgagcaaccacggggttacggccaccattactccccggtccccaagcgtcgaggtgcagctgccggattacggcgagctaaccctggattgcgagccgcggtccgggatcgatttcaatgagatgatacttatgaagatgaagaccaaaacctggcttgtgcacaagcagtggttcctggacctgcccctcccgtggaccaccggcgccgacacgctggaggtgcactggaatcacaaggagcggatggtgaccttcaaggtgccacatgctaagcggcaggacgtcaccgttttggggagccaagagggcgccatgcactccgccctcgccggcgcaaccgaagtagactccggggacgggaaccacatgtttgcgggacatctgaaatgtaaagtccgcatggagaagttacgaatcaagggcatgagctacacgatgtgctccggcaagttcagcattgacaaggagatggcagagacccaacacggaacaacagtggtaaaagtcaaatatgagggcacgggggccccctgcaaggtaccgatcgaaattcgggatgtgaacaaggaaaaagttgtgggccgcatcatatccagcactccctttgctgagaacaccaactccgtgactaacatcgagctcgagccgcccttcggggactcttacatcgtcattggcgtgggcgactccgccctgacgttacactggtttcggaagggatcctctatcggaaaaatgtttgagagcacataccgcggggcgaagcggatggcaatcctcggcgagaccgcctgggacttcgggtctgtcggcgggctgctcaccagcctcgggaaggctgtccaccaggtcttcggctccgtctatacgacgatgttcgggggcgtcagctggatggtgcgcatcctgatcgggctgctggtgctctggatcggtaccaacagcagaaacaccagcatggcgatgtcttgcatcgccgtcggtgggatcacactcttcctggggttcactgtgcacgcggacatggggtgcgtggtcagctggtccggcaaggagctcaagtgcgggagcggcatcttcgtgatcgacaatgtgcacacctggaccgagcagtacaagttccagccagagagccccgcccgcctggcctccgcaatcctcaacgcgcacaaggagggagtctgcgggatacggagcactacccgccttgagaacgtgatgtggaagcagatcaccaacgagcttaactacgtgctgtgggagggcgggcacgacctcaccgttgtggccggcgacgtgaagggcgtcctgtccaaggggaagcgggcgctggctccacccgtaaacgacctcaagtacagttggaaaacgtggggcaaggcgaagatatttacccccgaaacccgtaactctaccttcctggtggacgggccggacacatcagagtgcccgaacgaacgccgcgcatggaacttcctggaggtagaggactacggcttcggtatgttcaccacgaatatctggatgaagttccgggagggaagtagcgaagtgtgcgaccaccgcctcatgtccgccgccatcaaggaccagaaggcggtgcacgcggacatgggctactggatcgagagctcgaaaaaccagacctggcagatcgagaaggcctctctgatagaggtcaagacatgcttatggccgaagacccacaccctctggtccaatggggtgctggagagccagatgctgatacctaaggcctacgccggccccatctcccaacacaactaccggcaagggtatgcgacgcaaaccgccggcccttggcacctcgggaaacttgaaatcgacttcggcgaatgccccggtacgactgtgacagtccaggaggattgtgatcaccgcgggcccagcctgagaaccacgaccgcctcgggcaagttggtaacccaatggtgctgcagaagctgcacaatgccgcccctgcgcttcctgggggaggatggctgttggtacgggatggagatcaggccgctgaacgagaaggaagagaacatggtaaagagccaggtctctgccggccacggcacttctgaaaccttctcaatgggtctgctgtgcctcactctgttcgtggaggagtgcttgcgtcggagagtcacccgaaagcacatgatcctcgtggtggtgacgaccctgtgcgccattatcctgggcgggctcacctggatggacctcctgcgggccttgattatgcttggcgacaccatgagcgggaggatgggagggcaaattcacttggccatcatggctgtgttcaaaatgtccccaggatacgtgctcggcattttcttacgcaagttgacgagccgtgaaaccgccctgatggtcatcgggatggctatgaccaccgtgttgtcaatcccgcacgacctgatggagttcatcgacggcatctcactcggtctgatcctgcttaagatggtgacgcatttcgacaacacccaagtcgggaccctggcgctggcactcacgttcatcaagtccaccatgccgctggtgatggcatggcgcaccatcatggcggtgcttttcgtcgtgacgctcatccccctgtgccggacgagctgtctacagaagcagtcccactgggtcgagatcaccgccctcatccttggagcgcaggccctccccgtgtacctcatgaccctgatgaagggggcatccaagcggtcgtggccactaaatgaaggaatcatggccgtgggtctggtgtcgctgctgggctccgcgcttctgaaaaacgacgtccccctggccggaccgatggtggctggaggcctcctgctggccgcctacgtgatgagcgggtccagcgctgacctctcactggagaaggccgccaacgtccaatgggacgagatggccgacatcaccggctccagcccgatcatcgaagtgaagcaggacgaggacgggtcgttcagcatccgggatgtggaggagaccaacatgatcacgctgctggttaagctcgccctgatcacagtgtccggcctctacccactggcgatacccgtgaccatgaccctgtggtacatgtggcaagtaaagacgcagcgcagcggcgcactctgggacgtgccctcccccgccgcagcccagaaggcaaccctgacggaaggtgtttaccggatcatgcagcgcggcctatttggcaagactcaggtcggcgtggggatccacaccgagggggtgttccataccatgtggcacgtcacccggggcagcgtcatttgccacgaatccggacggctcgagccgtcatgggccgacgtacggaacgacatgattagctacggcggcggctggcgtctgggcgacaagtgggacaaagaggaggacgtccaggtgctggccatagagcccgggaagaaccccaagcatgtgcagacaaagccaggcctcttcaaaacactgacgggggagataggcgcggtcaccctggacttcaagccggggaccagcggctcccctataatcaacaggaagggcaaggtgatcgggctctatggaaacggggtggtcactaaaagcggcgactacgtgtccgcgatcactcaagcggagcggatcggcgaacccgactatgaggtagacgaggacatctttcgcaaaaagcggctgacaatcatggacctgcatccgggcgcgggcaagaccaagcgtatcctgccatcgatcgtccgtgaggccctcaaacgtcggctgcgcacactgatcctagccccaacgcgtgtggtggcggccgagatggaggaagccctgagggggctacctatccggtaccagactccggccgtcaagtccgagcatacgggcagggagatagtggatctcatgtgccacgccaccttcacgacacggttactgagctcaacccgagtgccgaactataacttaattgtcatggacgaagcccacttcacggaccccagctccgtggccgcccgaggatacatcagcacgcgcgtcgaaatgggcgaggccgcagcggtttttatgaccgccaccccaccggggacgaccgatcccttcccccaatcaaattcccccatcgaggacatagagcgggagattcctgagcgcagctggaacactggcttcgactggatcaccgactatcagggtaagaccgtctggttcgtcccctccattaaggccgggaacgatatcgctaactgcttaagaaagagcggcaagaaggtgatccaactatcccggaagacgttcgatactgaataccccaagaccaagctcaccgactgggacttcgtgatcacgaccgatatcagcgagatgggggccaacttcagggcaggccgtgtgatcgacccccgccggtgcctgaaacccgtgatcctgaccgatgggcccgagcgcgtgatactcgcaggaccgatacccgtcactccggcatccgccgcgcagcggcgcggccggatcggtcgcaaccccgcccaagaggacgaccagtatgtcttcagcggagacccccttcggaacgacgaggaccacgcccactggacggaggccaaaatgctgttagacaacatctacaccccagaaggaatcatcccgaccttgttcggccccgagcgcgagaaaacccaggccatcgacggcgaatttcgactgcgcggggaacagcggaaaacctttgtggagcttatgcgccggggcgaccttccggtctggttgtcccacaaggtagcgtccgccgggatatcctacaaagaccgcgagtggtgcttcacaggtgagcggaacaaccagatactcgaggagaacatggaggtggagatttggaccagagagggcgagaagaagaagctgcggcccaagtggctcgacgcccgagtctatgccgatccaatggcgctcaaggattttaaggagtttgcgagcggccgaaagagcattacccttgacatcctgactgagatcgccagcctcccaacttacctgtccagccgcgcaaaactagccctcgacaacatcgtgatgctgcacactacagagcgtggtgggaaggcttaccagcacgctcttaatgagctccccgagtccttagagacgctgatgctagtggccctgctgggcgccatgacggcgggtatctttctcttcttcatgcagggaaaggggatgggcaaactgagcatgggcctgatcgctattgccgttgcctccgggctcttatgggtggctgaaattcaacctcagtggattgctgcgtcgatcattctggagttcttcctcatggtactgctagtccccgagcccgagaagcagcgcactcctcaggacaaccagctcatatacgtgatcctgactatcctgactatcatcgccctcgtggccgctaacgagatgggcttgatcgagaagacaaagaccgacttcgggttctaccaagtaaaagcagagaccacaatcctggacgtggacctccgcccagcgtcagcctggacgctgtatgccgtcgccaccacgatcctgacccctatgcttcggcacacgatcgagaacacctccgcaaacctgtctctggcggccattgccaaccaggcagccgttctcatgggcctggggaagggctggcccctgcaccgcatggacctgggcgtgcccttactcgcgatgggatgctactctcaggtgaacccaaccaccctcacggcctctttagtaatgttgctcgttcattacgccatcattggacccgggctgcaagccaaggcgacccgggaggcccaaaagcgcactgccgccggcatcatgaagaaccctacggtggatggcatcacggtcatcgatctggagcccatctcgtatgacccgaaattcgagaagcagctaggacaggtgatgctgctggtgttgtgcgtcggacagttactgctcatgcggaccacgtgggccttttgcgaagtgctgaccctggcgacggggcccattctcaccctgtgggagggcaacccagggcgcttctggaacaccaccatagccgtatcaaccgccaatatcttccggggctcctacctcgccggggccgggctagcgttcagcctgatcaaaaacgcgcagacaccccgccggggtaccggaaccatgggcgagactctgggggagaagtggaagcgtcagctcaactcgctcgaccgtaaggaatttgaggagtacaagcgcagcggcatcctggaagtcgaccggaccgaggcccgctccgctttgaaggacggcagcaagatcaagtacgccgtgtcgagggggacgagtaagatacgctggatagtggagcggggcatggtaaaaccgaaggggaaagtggtagacctgggctgcggccgcggcgggtggtcctactatatggcgaccctgaaaaacgtcaccgaggttaaaggatacacgaagggcgggcccggccacgaggagcccatccccatggcaacctacggttggaaccttgtgaaacttcacagcggcgttgatgtgttctacaaaccgaccgagcaagtggacacgctgctctgcgacattggtgagtccagctccaatccaacgatcgaggaggggcggaccctgcgcgtcctgaagatggtcgagccatggctatcgtccaagcccgagttttgcatcaaggtcctcaatccgtacatgcctaccgtgatcgaggaattggagaagctgcagagacggcatggcgggtccctcgtgagatgccccctgtctaggaactctacacacgaaatgtactgggtcagcggggtgtccggcaacatcgtgagctccgtcaatacgaccagcaagatgttgctcaaccgctttaccacccggcaccgtaagcccacgtacgagaaagatgccgacctgggtgcgggcactcggtccgtgagcaccgagacagaaaagccggacatgacgatcatcgggagacggctccaacgcctccaggaggagcacaaggagacctggcattatgatcacgagaacccataccggacatgggcctaccatggctcctatgaggcccccagcacggggagcgccagctccatggtgaacggcgtcgttaaactgctgaccaagccgtgggacgttgtccccatggtgacccagctcgccatgaccgacaccacgcctttcggccagcagcgcgtttttaaggagaaagtcgacaccagaacccctcaaccgaaacccgggacccaagtggtgatgacgaccacagccaactggttgtggaccctgctcggccgcaagaagaacccccggctgtgcacgcgcgaggagttcatctctaaggtccggtccaacgccgccataggggccgtgttccaggaggaacagggctggacctccgccagtgaagccgttaacgacagccgcttctgggagttagtcgataaggaacgggcgctccaccaggaggggaagtgcgagagctgcgtgtacaacatgatgggcaagcgggagaagaagctaggcgagttcgggcgggctaagggctcccgcgccatctggtacatgtggttaggggctcgctttctcgagttcgaggctctgggcttcctgaacgaggaccactggttcgggcgggaaaacagctggtctggggtggagggcgaagggctccaccgcctgggctatatcctggaggacatcgacaagaaggacggggacctcatctacgcggacgacacggcggggtgggacacccggataacggaggacgacctgctcaatgaggaacttatcaccgagcagatgacaccccaccataagatactggccaaggccattttcaagctgacttaccaaaacaaggtcgtgaaggtgctcaggcctacccccaagggggcggttatggacatcatctcgcggaaagaccagcgcgggtccggtcaggtcgggacgtacggtctgaatacgttcacgaacatggaggtgcaactgatccgacagatggaggcggagggggtaataacccgcgatgatatgcacaaccccaagggcctcaaggagcgagtcgagaagtggctgaaagagtgcggcgtcgaccggctgaagcggatggccatcagtggggacgactgcgtcgtgaagcccttggacgagcgcttttcaacgagcttactgttcctcaacgacatggggaaagtgcggaaggacatcccgcagtgggagccctccaagggctggaagaactggcaggaagtaccgttctgctctcaccacttccacaagatatttatgaaggacgggcgcagtcttgtggtgccctgccgtaaccaagacgagctgatcgggcgcgcgaggatcagccagggcgcgggttggtcgctccgtgaaaccgcgtgcttaggtaaggcgtacgcccaaatgtggagcctgatgtacttccacaggcgcgatctccgcctggcctcaatggctatctgctcagcggttcccaccgagtggttcccgaccagccggacaacgtggagcatccacgcccaccaccaatggatgacaaccgaggacatgctgaaagtgtggaaccgcgtctggatcgaggacaaccccaacatgattgacaagacgcccgtacactcctgggaggacatcccgtacctcggaaaacgtgaggacctgtggtgtgggtccctaatcggcctctcatcccgcgcgacctgggccaagaacatccacaccgctatcacgcaagtgcggaacctgatcgggaaggaggagtacgtagattacatgccggcaatgcgccggtacagcgcccacttcgaatccgagggcgtcctgtga

SEQ ID NO: 26343 - RNA, 9867 nt, synthetic construct
  misc_feature 1..9867: note = derived and/or modified CDS sequence (opt11) from DENV-4__KT026309__SS-prME
  source 1..9867: mol_type = other RNA
tccaccatcaccctgctctgtctgatcccaactgtgatggccttccacctctccactcgcgatggggaaccgttaatgatagtcgctaagcacgaaagagggagacccttgttgttcaagaccaccgaaggcatcaacaagtgcactctcatcgcgatggacctgggggaaatgtgcgaagacaccgtgacctataagtgccccctgctcgttaacaccgagcccgaggatatcgattgttggtgcaatttaacgagtacctgggtgatgtacggaacctgcacccaatccggtgagcggcgccgggagaagaggagcgtggccctgacgccccactccggcatgggcctcgagacccgcgccgaaacgtggatgagctccgagggcgcctggaagcacgcccagcgcgtggagagctggatcctccggaaccccgggttcgcattacttgccgggttcatggcctacatgatcggccagacggggatccagcgaaccgtcttcttcatcctcatgatgctggtggccccctcctacgggatgcggtgcgtcggcgtcgggaatcgcgacttcgtcgagggcgtaagcgggggcgcgtgggtcgacctcgtacttgagcatggcgggtgcgtgaccacgatggcccagggcaagcctaccctggacttcgagctcattaagaccactgcgaaggaggtagccctgctgcggacctactgcatcgaagcatcgatcagcaacatcacgacggcgacccgctgcccgacgcagggggagccctacctcaaggaggagcaggaccagcagtatatctgccgtcgcgatatggtggaccggggctgggggaacggctgcggcctgttcgggaagggcggggtggtaacctgcgccaagttttcctgccttggcaaaatcacggggaacctcgtgcagattgagaacctggaatacaccgtagtcgtgactgtgcacaacggcgacacccacgccgtcggaaacgacacgtcaaaccacggggtgaccgccaccatcaccccgcgatcccccagcgtcgaggtgcagctgccggattacggcgaactcactttggactgcgagccgcggtcggggatagacttcaacgagatgatcctgatgaagatgaaaaccaagacctggctcgtgcacaagcagtggttcctggacctgcccctcccctggaccaccggcgccgacacccttgaagtccactggaaccacaaggagcgcatggtgactttcaaggttccgcatgcgaagcggcaggacgtgaccgttctggggagccaagaaggcgccatgcactccgccctcgccggcgccacggaggtagacagcggggacgggaaccacatgttcgcggggcatcttaaatgcaaggtccgaatggagaagttgcgcatcaagggcatgagctacacgatgtgcagtggcaagttctccatcgataaggagatggccgagacccaacacggcaccaccgtggtgaaggtcaagtacgagggcacgggtgcgccctgcaaggtgcccatcgagatccgggatgtcaacaaggagaaggtagtggggcgcatcatctcctcaacgcctttcgccgagaatactaactccgtgaccaacatcgagcttgagccgcccttcggggatagctacatcgtcatcggcgttggcgactccgctctgactctgcactggttccggaaggggagctccatcggaaagatgttcgagtccacctaccgtggggcaaagcggatggcgatcctcggcgaaacagcctgggacttcgggtccgtgggcggcctgctgaccagcctcggaaaggccgtgcaccaagtgttcggctcggtatacaccaccatgtttgggggagtcagctggatggtgcgcatactgattggactgctggtgctctggatcggtaccaactcgcggaacacgagcatggcgatgagctgcatagcagtaggcgggatcacgctattcctgggcttcaccgtgcacgctgatatgggctgcgtggttagctggtccggcaaggaactcaaatgtggatccgggatcttcgtgattgacaacgtgcacacctggactgagcagtataagttccaacctgaaagccccgcccgcctagcctcggcgattctgaacgcccataaggagggtgtctgtggtatccggagcacgacacgcctcgagaacgtaatgtggaagcagatcaccaacgagctgaactacgtgctgtgggagggcgggcatgacctcactgtcgtggccggcgacgtaaagggagtcctgtccaaggggaaacgcgccctagccccgcccgtgaacgacctcaaatactcctggaagacttggggcaaagcgaagatcttcacccctgagacccgtaactccacttttctcgtagacggtccggacacaagtgaatgcccaaacgagcggcgcgcctggaacttcctggaggtcgaggactatggcttcgggatgttcacaaccaacatttggatgaagttccgggaaggctccagcgaggtgtgtgaccaccgcctcatgtccgccgcaatcaaagatcagaaggccgtgcacgccgacatggggtactggatagagagctccaagaaccagacctggcaaatcgagaaagccagcctaatcgaggtgaagacgtgtctatggcccaagacccacaccctctggtccaacggggtgctggagagccagatgttaatccctaaggcctacgccggcccgatctcccagcataactaccggcaggggtacgcgacgcagaccgccggcccttggcacctcgggaaactggagattgacttcggcgagtgcccagggacgactgttaccgttcaggaagactgcgaccaccgggggcccagcctgcggaccacgaccgcctccggcaagctagtgacccaatggtgctgccgctcttgcacaatgccgcccctccgattcctgggggaggacggctgctggtatgggatggagattcggccactcaacgagaaagaggagaacatggtgaagtcgcaggtctccgccggtcacggcacgagcgagacattctccatggggctgctgtgcttaacactcttcgtggaggagtgcctgcgccggcgagtcacacggaagcacatgatcctcgtggtagtaacgaccttatgcgccatcatccttggagggctcacgtggatggacctgctgcgcgcgttgatcatgctgggcgacaccatgtcgggccggatgggagggcaaatccatttagccatcatggccgtcttcaagatgagccccgggtacgtgctcgggatcttcctgcgcaagttgacgagccgcgaaaccgccctcatggttatcgggatggcaatgaccacagtgctctccatcccgcatgatctcatggagttcatagacggcatcagcctcggactaatcctgctaaagatggtgacgcacttcgacaacacccaggtcgggaccttagcgctggctctaaccttcatcaagtccacgatgcctctggttatggcctggcgaaccatcatggccgtgctgttcgtcgtaacccttatcccactgtgtcggacctcctgccttcagaaacagtcccactgggtggagatcacagccctgatcctgggcgcgcaggccttacccgtctaccttatgaccctgatgaagggggctagcaagcgcagttggccgctgaacgagggcatcatggccgtgggcctcgtgtcactgctgggatccgccctcctgaaaaacgacgtccccctggccggccccatggtggccgggggcctcctgctggccgcctacgtgatgtcagggtccagcgccgacctgtcactggaaaaagccgctaacgtccagtgggacgagatggctgatatcaccggtagcagccccattatagaggttaaacaggacgaggacgggagttttagcattcgggacgttgaggagacaaacatgatcaccctgttagttaaactagcactaatcaccgtatccggcctctacccgctggcgatcccagtaaccatgaccctgtggtatatgtggcaggtcaaaacacagaggtcgggcgctctctgggacgtgccctcccccgccgccgcccagaaggcgaccctgactgagggggtataccggatcatgcagaggggactgtttgggaagacccaagtcggggtggggatacacaccgagggcgtcttccacacgatgtggcacgtcacccggggcagcgtgatctgccacgaatccggtaggttagagcctagctgggccgatgtgcggaatgacatgatctcgtatggaggagggtggcgcctgggcgacaagtgggacaaggaggaggacgtccaggtgctggcgatcgagccagggaagaacccaaagcacgtacaaacaaagcctggccttttcaagaccctgacgggggagatcggcgccgtcactctggatttcaagccggggactagcgggtcccctatcataaaccggaagggcaaggtgatcgggctctacggcaacggggtggtcaccaagagcggcgactacgtgtccgccatcacccaggctgagcgaataggtgagcccgactatgaggtggacgaagacatctttcgcaagaagcggctgactatcatggacctgcacccaggtgccggaaaaacaaagcgcatcttgcccagcatcgtccgggaggctctgaagcgccggttgcgcacccttatcctcgcccctacgcgtgtagtagcggccgagatggaggaggcattgagagggctacccatacgataccaaaccccggccgtcaaaagtgagcacactgggcgcgagatcgtggacttaatgtgccatgccacctttaccacccggttactatcctccacccgcgtccccaactacaacctcattgtaatggacgaggcgcacttcaccgatcccagcagcgtagccgcccgggggtacatcagcactcgcgtcgaaatgggcgaggccgctgctgtgtttatgactgccacacccccggggaccacggaccccttcccacagagcaactcccccatcgaagacattgaacgggagatcccggagcgaagctggaacaccggcttcgactggatcaccgattaccaaggcaagaccgtgtggttcgtcccttccatcaaggccgggaacgacatcgccaactgcctgcggaagtccggcaagaaggtgatccagctgagccggaagacgttcgataccgagtacccaaagaccaagctcactgactgggacttcgtgatcacaaccgacattagcgaaatgggcgccaatttccgggcgggccgcgtcatcgacccccgccggtgtctgaagcctgtgatcctgaccgacgggccggaacgcgtgattcttgctggccccatcccggtcaccccggccagtgccgcccagcggcgcggccggatcgggaggaaccccgctcaagaggacgaccaatacgtattctccggcgaccccctgcggaacgatgaggaccacgcgcattggacggaggccaagatgttgctcgataacatctacacccccgaggggatcataccgaccctattcggtcctgagcgcgagaagactcaagccatcgacggcgagttccggctgaggggcgaacagcggaagacgttcgtagagctcatgcgtcgaggggatctcccggtatggctctcccacaaggtggcgagcgccgggatctcgtacaaggaccgcgagtggtgctttacaggcgaacggaacaaccaaatcctcgaggagaacattgaggtggagatctggacccgcgagggggagaagaagaaattgcggcccaagtggctagacgcgcgcgtttacgccgacccgatggctctcaaggacttcaaggagtttgcgagcggtagaaagtccatcacattggacatactgaccgagatcgcctcgctcccgacgtacctatccagccgcgccaagctggccctggacaacatcgtgatgctacacactaccgagaggggagggaaggcctaccagcacgcgctgaacgagttgcccgagtccctggagaccctgatgctcgtggccctgctgggcgccatgacggccgggatcttcttattctttatgcagggcaaaggaatgggcaagctgtccatgggcctgatcgcgatcgccgtcgccagcggtctcctgtgggtggccgagattcagccgcagtggatagcggccagtatcatcctggagttcttcctcatggtgctgctggtgcccgaacctgagaagcaacgcacccctcaggacaaccagctcatctacgttatcctcacgatccttaccatcatcgcactcgtagccgccaacgagatgggcctgatagagaagacgaagaccgacttcggcttttaccaggtcaaggccgagaccacgatcctggatgtagacctccgcccggcgagcgcctggacgttgtacgcggtggccaccactattctgacccccatgctccggcacacgatcgagaatacgtccgccaacctgtctctggcggcgatcgccaaccaggctgccgtacttatgggcctagggaaaggctggcccctgcatcgcatggacttaggagtgcccctgctggcgatggggtgctactcccaggtcaacccgaccactctcacagcctcactggtaatgctactggtgcactacgccatcatcggcccggggctgcaggccaaggccacccgggaggcccagaagcggacagcagccggcataatgaagaaccctaccgtggacgggatcacggtcatcgacctggaacctatctcctacgacccgaagttcgaaaaacaactaggacaggtgatgttactcgtgctctgtgtaggtcaactactgctaatgcggacgacctgggccttctgtgaggtgctgaccctggctacggggcctatactaacactgtgggagggcaaccccgggcgtttctggaacaccaccatcgccgtgagcacggccaacatcttcaggggatcctacctggccggagccgggctcgcgttcagcctgatcaagaacgctcaaaccccgcgacggggcactggaacgatgggagaaactctgggggagaagtggaagcgacagttaaactccctggacagaaaggagttcgaggagtacaaaagaagcggcattctggaggtggaccggaccgaagcacgttccgccctgaaggatggcagcaaaatcaagtacgccgtatcgaggggaacgagcaagattagatggatcgtggagcggggcatggtaaagccgaagggcaaagtggtagacctgggatgcggccggggcggttggtcctactacatggcgaccctcaagaacgtcaccgaggtaaaggggtatacgaagggtgggcccgggcacgaggagcccattcccatggccacctacggatggaatctggttaagctacatagcggcgtcgacgtcttctacaagccgaccgaacaggttgacaccctgctatgcgacataggcgagtcatcatccaaccctacaatcgaggaggggagaaccctcagggtcctgaagatggtggagccttggctgtcctcgaagcccgagttctgtatcaaggtgctcaacccgtacatgcccaccgtgatcgaggagctcgagaagttgcagaggcggcacggcgggtccctcgtccgctgccctttgagccggaacagcacccacgagatgtactgggtaagcggggtgtcgggtaatatcgtgtcaagcgttaacacgacgagcaaaatgctgttgaacaggttcacgacgcggcaccgcaagcccacgtacgagaaagacgccgacttaggggccggcacccggtccgtaagcaccgaaaccgagaagccggacatgaccatcattgggcgcaggctgcagcgcctccaggaggagcataaagagacctggcactacgaccacgagaacccctaccggacctgggcgtaccatggctcctacgaggcccccagcaccgggtccgcctcctccatggtaaatggcgttgttaagttacttacgaagccgtgggacgtggtcccgatggtaacccagctcgccatgaccgataccacgcccttcggccagcaacgcgtctttaaggagaaggtcgacacgcggacgcctcagccgaagcctgggactcaggtggttatgacgaccactgccaactggctgtggaccctgctcggccgcaagaaaaacccccggctgtgcacgcgcgaggagttcatctcgaaggtcagaagcaatgcggcgatcggggccgtgttccaagaggagcaggggtggacgagcgccagtgaggccgttaacgacagccgcttctgggagctggtcgacaaggaacgggcgctgcaccaggagggaaaatgcgaatcctgtgtgtacaacatgatgggaaagagggagaagaaacttggcgagttcgggcgggccaagggcagccgcgctatatggtacatgtggctgggggcccgcttcctcgagttcgaggccctgggcttcctgaacgaggaccattggttcggcagagagaacagctggtccggcgtggagggcgaggggctccaccgcctgggctacatccttgaggacatcgacaagaaggacggggacctcatttacgcggacgacaccgccggatgggacacccggatcacagaggacgacctgcttaacgaggagttgatcaccgagcaaatgacaccccaccacaagatcctggccaaggctattttcaagctgacttatcagaacaaggtcgtgaaggttctccgcccgacccccaagggcgcggtaatggacatcattagccgtaaggaccaacgtgggagcggccaagtggggacgtacggcctgaacacctttactaacatggaggtgcagctgatccggcagatggaggccgaaggagtcatcaccagggacgacatgcacaaccccaaaggcctgaaagagcgggtggagaaatggctgaaagaatgcggcgtggaccgcctgaagcggatggccatctcaggagacgactgtgtagtgaagcccctcgacgagcgcttctccacgagcctgctattcctcaacgatatgggcaaggtacgcaaggatattccgcaatgggagccctccaaggggtggaagaactggcaggaggtacccttctgcagccaccacttccacaaaatcttcatgaaggacggcagatccctggtcgttccctgccgaaaccaggacgagctgatcggtcgcgcccggatcagccagggggccggctggtccttgagagagaccgcgtgcctggggaaggcgtacgctcagatgtggagcctgatgtactttcaccggagagatctccgcctggcctccatggccatctgctcggccgtcccgaccgagtggtttcccacttcccggaccacctggagcattcacgcacaccaccaatggatgaccacggaagatatgcttaaggtctggaatcgcgtgtggatcgaggacaaccccaacatgatagacaaaacgcccgtccactcctgggaggacatcccgtacttggggaagcgggaggacttatggtgcgggtcactgatcggcctctcgtcccgggcaacgtgggcaaagaacatccatacggccatcacacaggtgcgcaacctgatcgggaaagaggagtacgtcgactacatgcccgcgatgcgccgctactcagcccacttcgagtccgagggcgtcctatga

SEQ ID NO: 26344 - RNA, 9867 nt, synthetic construct
  misc_feature 1..9867: note = derived and/or modified CDS sequence (opt11) from DENV-4__KF907503__SS-prME
  source 1..9867: mol_type = other RNA
agcaccatcacccttttgtgcctgatccccactgttatggccttccacctgagcacccgcgatggcgaaccgttaatgatcgtagccaagcatgagcggggccgcccgctgctgttcaagactaccgagggcatcaacaagtgcaccctcatagcgatggacttgggggaaatgtgcgaagacaccgtgacctacaagtgcccgctgctcgtgaacacagagcccgaggacatcgactgctggtgcaacctgacatccacctgggtaatgtacgggacctgcacccagagtggcgagagacgacgggagaaacgcagcgtggcgcttactccgcactccggcatgggtttggagacccgggccgagacctggatgagctctgagggggcatggaagcacgcccagagagtagagtcatggatcttacggaaccccggctttgcactgctcgccgggtttatggcctacatgatcggccagaccgggatccagcgcaccgtattcttcgtgttgatgatgctggtggcgccgagctatgggatgagatgcgtcggggtggggaaccgcgacttcgtggagggcgttagcgggggcgcatgggtagaccttgtgctcgaacacggcgggtgcgtaaccaccatggcccagggcaagcccaccctggacttcgagttaacaaagacgactgctaaggaggtggccctgctacggacctactgtatcgaagccagtatctctaacatcaccactgccacccgctgcccgacccagggggagccgtacctaaaggaggagcaagaccagcagtacatctgccgacgcgacgtggtcgaccgcggatgggggaacggctgcggcctgttcggaaagggcggggtcgtgacgtgcgccaaattctcctgcagcggcaaaatcaccgggaacctggtccagatcgagaacctcgaatacactgtggtggtgacggtgcacaatggcgacacgcacgccgtcggcaacgacacctccaaccatggggtgacagctatgatcacgccgcggtctccttccgtcgaggtcaagctacccgactacggcgagctaaccctcgactgcgagccccggagcggtatcgactttaacgagatgattctgatgaaaatgaagaagaagacttggctggtgcacaagcaatggtttttggatctgcccttaccctggaccgctggagcggacacctccgaggtgcactggaactacaaggagcggatggtaaccttcaaggtgccgcacgccaagcggcaggacgtgacggtcctcgggagccaggagggcgccatgcacagcgccctggcaggtgcgacggaggtggactccggggacgggaaccacatgttcgccgggcatctgaaatgcaaagttcgcatggagaagcttaggataaagggcatgagctacaccatgtgttccggcaaattcagcatcgacaaagagatggccgagacccaacacgggacgaccgtcgtgaaggttaaatatgagggcgccggggccccctgcaaggtacccatcgagatccgggacgtgaacaaggagaaggtggtcggacgcatcatttcgagcacgcccctggctgagaacaccaactccgtgacaaacatcgaactggagccgccgtttggggatagctacatcgtgatcggtgtcggaaactcggccctcacccttcactggttccggaaagggtcatccatcggaaagatgttcgagtccacctatcgcggggccaagcgtatggccatcttaggggagaccgcgtgggacttcgggtcagtgggcggcttattcacgagcctgggaaaggccgtgcaccaggtcttcggctcagtgtataccaccatgttcggtggcgtgagttggatgatccgcatactgattgggttcctcgtcctgtggattggcacgaattcgagaaacacgtcaatggctatgacttgcatcgccgtaggcgggatcaccctgttcctgggcttcaccgtgcaggccgatatggggtgcgttgtgtcatggagcggcaaggagctcaagtgcgggagcggcatcttcgtggtcgacaacgtgcacacgtggaccgagcaatataaattccagcccgaatcccccgcgcgcctggccagcgccatactgaacgcccataaagacggtgtgtgcgggatccggtctactacacgactggagaacgtcatgtggaagcaaatcacgaacgagctgaactacgtactgtgggagggcgggcacgacctcaccgtggtcgccggcgacgtgaagggagttctgaccaaggggaagcgggcactgaccccgccagtctcggacctcaagtactcctggaaaacgtgggggaaggccaagatattcacccctgaggctcgaaacagcacctttctgatcgacggtccagataccagcgaatgcccgaacgagcggcgcgcctggaacagcctggaggtggaagactacggcttcgggatgttcacgaccaatatctggatgaagttccgggaggggtcctctgaggtgtgcgaccaccgcctcatgtcggccgcgatcaaggaccagaaggccgtccacgccgatatgggctactggatcgagtcgtccaagaaccagacctggcagatcgagaaggctagcttgatcgaggtgaagacctgcttatggcccaaaactcatacgctctggtccaacggggttctggagagtcagatgttgatccccaagtcctacgctggcccgtttagccagcacaattaccggcaagggtacgcaacacagaccgtgggcccctggcacctcgggaaactggagattgacttcggcgaatgccctggaaccaccgtgaccatccaggaggactgcgaccacagggggccctccctcagaacctctactgcctccggcaagctcgtaacgcagtggtgctgccgctcctgcactatgccgcccctgcgcttcctaggggaggacgggtgctggtacgggatggagatccggccccttagcgagaaggaggagaacatggtcaagtctcaggtgaccgccggccagggcaccagcgagaccttctctatggggctgctgtgtctcaccctgttcgttgaggagtgtctgcgccggcgcgtgactcggaagcacatgatcttagtggtcgtgatcaccctgtgcgccatcatcctgggcggcttgacgtggatggacctgctgcgcgcgctcatcatgctgggagacaccatgagcggccggattgggggccagatccacctggccatcatggccgtgttcaagatgtctcccgggtacgtcctcggcgtgtttctgagaaagctgaccagcagagagaccgccctcatggtgatagggatggcgatgacgaccgtcctgagtatcccccacgaccttatggagctcatcgatgggattagcctgggactgatcctcctgaagatcgtaacccaattcgacaacactcaggttggcacgctggcgctctcactgaccttcatcaggtcaacaatgcccctgatcatggcctggcggactatcatggcagtgttgttcgtcgtgacgctgattcccctatgccgcacctcctgccttcagaagcagagtcactgggtcgaaatcacggccctgatcctgggtgcacaggcgctccccgtctacctgatgaccctgatgaagggcgcctcccggcggtcatggcctctcaatgagggcatcatggcggtgggtctggtcagtttgctcggcagcgccctgttgaagaatgatgtgcccctcgctggcccgatggttgcaggcggccttctgctcgccgcctacgtcatgagcgggtcctccgccgacctgtccctggagaaggcggcgaacgtgcagtgggacgagatggcagacatcacaggcagctcccctatcatcgaggtcaaacaggacgaggacgggagcttctcaatcagagatgtcgaggagaccaacatgatcaccctcttggtgaagctggccctaattactgtgagcggcttgtacccgctggcgatccccgtcacgatgacactgtggtacatgtggcaggtcaagacacagcgctcaggcgcgctctgggacgtgcccagccccgccgctacccaaaaggccgccctgtccgagggggtctacagaatcatgcagcgcggcctcttcgggaagacccaagtcggcgtaggaatccatatggagggcgtcttccacacaatgtggcacgtgacgcggggtagcgtgatctgccatgagaccggacgcctggagccgtcgtgggcggacgtccggaacgacatgatcagctacggtggcggctggcgcctgggagacaagtgggacaaggaggaagatgttcaggtgctcgctatagagcccgggaagaaccccaagcatgtccagaccaagcccggcctgttcaagacactgaccggggagatcggtgcggtgaccttggacttcaagccgggaacctcgggtagccccatcatcaatcgcaagggcaaggtgatcgggctgtatgggaacggggtcgtgaccaagtccggggattacgtgagcgctattacccaggccgagcggatcggagagcccgactacgaggttgacgaggacattttccgcaagaagcggctgaccatcatggacctccacccgggcgctgggaagaccaagcgtatcctaccctccatcgtgcgggaggccctgaagcgtcggctgaggacgctcatcctggcacccacccgggtggtcgccgctgagatggaggaagctctgagggggttaccaatcaggtaccaaacgccggcggttaagagcgaacataccggccgcgagatcgtcgatctgatgtgccacgccacgagcacaacccggctgctctccagcacccgcgtccccaactacaacctgatcgtaatggatgaggctcacttcactgacccctccagtgtcgcggcccgagggtacatatccacgcgcgtagagatgggcgaggccgccgcaatcttcatgaccgccacgcctccgggggcgactgatccttttcctcagagcaactccccaattgaggacatcgagcgtgagatcccggagcgcagctggaacaccggtttcgactggatcaccgattatcagggcaagaccgtgtggttcgttcccagtataaaggccggtaacgacatcgccaactgcttacgcaagagcggcaagaaggtgatccagttgtcgcgcaagaccttcgacacggagtaccccaagactaagcttaccgactgggacttcgttgtcacgaccgacatctcagagatgggggccaatttccgagcgggccgggtgatcgacccccgcaggtgtctgaagccggtcatattaacagacgggcctgaacgggtaatcctagccggccccattcctgtaaccccggcctctgcagcccagcggcgcggccggattgggaggaacccggcacaagaagacgatcaatacgtgttttcaggtgaccccctgaagaatgacgaagaccacgcccactggacggaagcgaagatgctcctggacaacatctacacccccgagggcatcatcccgaccctgttcggtcccgagagagagaagacacaagccatagacggggagttccgcttacgaggtgagcagcgcaagactttcgtcgagctgatgcggcgtggagacttaccagtgtggctctcgtacaaggtggctagcgccgggatttcctacaaggacagggagtggtgtttcaccggcgagagaaacaatcagatcctggaggagaacatggaggtcgagatctggacccgggagggggagaagaagaagctgcgcccccggtggctcgacgcccgcgtatacgcagacccgatggcattaaaggacttcaaggagttcgcgagcggccggaagtccatcacccttgacattctcactgagatcgccagcctgcccacctatctgagctcaagggccaagctcgcgctcgacaatatagtgatgctgcacaccaccgaacgcggcgggcgggcctatcagcacgcgctcaacgagctgcccgagagcctggagaccctcatgctggtcgctctgctcggcgctatgacggctggcatcttcctgttttttatgcagggcaaaggaatcggaaagctgtcaatgggtctcattatcatcgccgtcgcatcggggctgttgtgggtggcggagatccaaccgcaatggatcgccgcctccatcattctcgagtttttcttgatggtcctcctcatacccgagcccgagaagcaacgcaccccccaagataaccaactgatctacgtgatcttgactatcttgaccataatcgggctgatcgcggccaacgagatggggctcatagaaaagacgaagaccgacttcggcttttaccaggtgaaaaccgagaccacgatcctcgatgtcgatctgcgacccgccagcgcctggaccctgtacgccgtagcgaccaccatcctcacgcccatgctgcgccataccatcgaaaacacctcggccaacttgagcctcgcagcgatcgccaaccaggcagccgttcttatggggctgggcaagggttggcccctacaccggatggacctgggggtgccactgctcgccatggggtgctacagtcaggtgaacccgactacactgaccgccagcctggtgatgctctcggtacactatgcgatcatcgggccaggcttgcaggcgaaggccacacgcgaggcccagaagcgcaccgccgcgggcatcatgaaaaaccccacggtggacggcatcaccgtgatcgacctggaacccatcagctacgaccctaagttcgagaagcagctgggccaggtgatgctgcttgtgctgtgtgccgggcagctgctgctcatgcggaccacctgggccttctgcgaggtgttgacgttagccaccggccccattctcaccctctgggagggcaaccccggccggttttggaataccacaatcgccgtctccaccgcgaacatcttccgtgggagctacctcgccggggccggcttagccttttccctgatcaagaatgcccagacgcccaggcgcgggaccggcacgaccggcgagactttaggagagaaatggaaacggcagctcaactcactggacagaaaggagttcgaggaatacaagcggagtggcatactggaagtggaccgcaccgaagccaagagcgcgctcaaggacggatccaagataaagcacgccgtcagcaggggcagctccaagattcgctggatcgtcgaacgcgggatggtcaagccaaagggcaaggtggtcgacctgggatgcggccgcggagggtggagttactacatggccacgctgaagaatgtcaccgaggtgaagggatacaccaagggaggccccgggcacgaagaacccatccccatggcgacctacggctggaatctcgtgaagctccattccggcgtagacgtcttctacaaaccgactgaacaggtcgatacgttactctgcgacatcggagaaagttcaagcaaccccaccatcgaggagggcaggacactgcgggtgcttaagatggtggagccatggctatcaagcaagcccgagttctgcatcaaggtccttaacccctatatgcccacggtgatagaggagctggagaagctgcaacgcaagcacgggggcaacctagttcggtgccccctgtcccgcaactcaacccacgaaatgtactgggtgtcgggcgcgtctgggaacatcgtgtcctccgtcaacacgacctccaaaatgcttctcaaccggttcacgacgcgccataggaagcccacctacgaaaaggacgtggacctgggggccggcaccaggagcgtgtccaccgagacggagaaaccggacatgaccatcatcggtaggcgcctgcagcgtctacaggaggagcacaaggagacctggcactatgaccaggaaaacccctaccgcacctgggcctatcacggatcgtacgaggccccctccacgggcagcgcgagcagtatggtcaacggcgtggtgaagctgctgaccaaaccgtgggatgttatccccatggtgacccagctcgccatgacggacacgaccccattcggtcaacagcgggtgtttaaggaaaaggtcgatactcgcacgccgcagccgaagcccggcactcggatggtgatgactaccaccgccaactggctgtgggccctgcttgggaagaaaaagaacccacgattatgcacgcgggaggagttcatcagcaaagtgcgcagtaacgcagcgataggcgctgtcttccaggaggagcaggggtggacgagcgcctcggaggccgttaacgacagtcggttttgggagctggtggataaagagcgcgcgctccaccaggaaggcaaatgtgagtcctgcgtctacaacatgatggggaagcgggaaaaaaaactgggggagttcggccgcgcgaaggggagccgcgccatctggtatatgtggctgggcgcccggttcctcgagttcgaggccctggggttcctcaacgaggaccactggttcggccgcgagaactcctggtcgggcgtggagggggagggcctgcatcgcctggggtacatcctggaggagatcgacaagaaggacggagacctgatgtacgccgacgataccgccggctgggatacccgaatcacggaggacgacctgcagaatgaggagctgatcaccgaacaaatggccccccatcacaagatcttggccaaagccattttcaaattgacctaccagaacaaggtggtcaaggtgctgcggcctacgcctcgcggggcggtgatggatatcatatcccggaaggatcagagaggaagcggccaggtgggaacgtacgggctcaacactttcacaaatatggaagtccagctgatccgacagatggaggccgagggcgtgatcacgcaagacgacatgcaaaatccgaagggcctgaaagagcgcgtcgagaagtggctcaaggagtgcggggtagatcggctgaagcgcatggccatctccggcgacgactgcgtagtaaagcccctggacgagcgattcgggacttctctactatttttgaatgatatgggcaaggtgagaaaggacatcccgcaatgggagcccagcaagggctggaaaaactggcaggaagtacccttctgcagccatcactttcacaagatcttcatgaaggacggccggagcctagtcgtgccctgtcgcaaccaggatgagctgatcggcagagcgcgcatcagccaaggggctgggtggagcctgcgggagacggcttgcctcggcaaggcgtatgcccagatgtggtccctgatgtacttccaccgccgcgacctgcgactcgctagcatggccatctgctccgcagtgccgaccgagtggttccccacaagccgcaccacgtggagtatccacgcgcaccaccagtggatgacaaccgaagacatgctgaaggtttggaaccgggtctggatcgaggacaacccaaatatgactgacaagactcccgtacacagctgggaggatatcccgtacctgggcaagcgcgaggacctctggtgtgggtccctgatcggcctgagctcccgggccacctgggccaagaacatccacactgccatcacccaggtccgcaacctcatcggcaaggaggaatacgtcgactacatgcccgtaatgaaacggtacagcgcgccctccgaaagcgagggggtcctgtag

SEQ ID NO: 26345 - RNA, 9867 nt, synthetic construct
  misc_feature 1..9867: note = derived and/or modified CDS sequence (opt11) from DENV-4__AY947539__SS-prME
  source 1..9867: mol_type = other RNA
tcaactatgaccttattatgccttatccctaccgccatggccttccacctctccacccgcgacggggagcccctcatgatcgtcgccaggcacgaacgcgggcggcccctgttattcaagactaccgagggcattaacaaatgcacgctcatcgccatggaccttggcgagatgtgtgaggacaccgtcacctacgagtgccctctgctggtgaatactgagcccgaagacatagattgttggtgcaacctgaccagcgcctgggtaatgtacgggacctgcactcagtccggggagcgccggagggagaagcggagcgtcgctctgacgccccactccggcatgggcctcgagacccgcgccgaaacctggatgtcgtccgaaggggcgtggaagcacgcccagcgggtggagagttggatcctgcgcaaccccggatttgcgctgctcgccgggtttatggcgtacatgatcggccagaccggaatacagcggaccgtgttcttcgttctgatgatgctcgtggccccttcctacggcatgcgctgcgtgggcgtcggcaacagagactttgtggaaggcgtgagcggaggcgcctgggttgacctcgttctggagcacggcgggtgcgtcacgaccatggcgcagggcaagccaactctggatttcgagttaataaaaacaacggcaaaggaggtcgcgttactgcgcacctattgcatcgaggcaagtatcagcaacatcaccaccgccacgcggtgccccacccagggggagccctacctcaaggaggagcaggaccagcagtatatctgccgtcgggacgtggtagaccggggctgggggaacggctgcggcctgtttgggaagggtggcgttgtaacatgcgccaagttttcctgttcggggaagatcaccgggaacctggtacagatagaaaacctcgagtacacggttgtcgtgacagtccacaacggcgacacccatgccgtgggcaatgatatccccaaccacggggtcaccgcgaccattacgccccggagcccaagcgttgaggtgaagctgcccgactacggtgagctgaccctcgactgcgaacctcgctccgggattgacttcaacgagatgatcctcatgaagatgaagaagaaaacttggctggtccacaagcaatggttcttggacctccccctgccatgggccgccggagccgacacgtcggaagtgcactggaactacaaggagcgcatggttactttcaaggtcccccatgccaaacgccaggacgtgacggtgctcggaagccaagagggcgcgatgcacagcgctctaaccggcgccaccgaggtggacagcggggatggcaaccacatgtttgccggccacctcaagtgcaaggtgaggatggagaagctccggatcaagggcatgtcctatacgatgtgctcaggtaaattctccatcgacaaggagatggctgaaacccagcacggcacgaccgttgtcaaggttaaatacgagggggctggagcgccctgcaaggtaccgatcgagatacgcgacgtcaataaggagaaggtggttggccggatcattagctccactccgttcgccgagtacaccaatagcgtcaccaacatcgaattagagccgccatttggggattcctacatagttatcggcgtgggggacagcgccctgacgctgcactggttccggaaggggtcctcgatcggcaaaatgttagaatccacgtatcgcggggccaagcggatggctatcctgggcgagaccgcctgggattttgggagcgtcggtggcctcctgacttccctggggaaggctgtgcaccaggtgttcgggagcgtctacactacgatgttcgggggcgtttcctggatggtgcggatcctcatcgggttcctggtcttatggatcggaacgaacagccgcaacacctccatggccatgacctgcatcgcagtgggcggtatcacactcttcctcggcttcaccgtgcacgccgacaccgggtgtgcggtcagctggtccggtaaggagctaaagtgcgggagcggaattttcgtgatagacaacgtgcacacttggacggaacagtacaagttccagcccgagtctccggcgcgcctggccagtgcaatccttaatgctcacgaggacggcgtttgcgggattcgcagcaccacccggcttgagaacatcatgtggaagcaaatcaccaacgaactgaactacgttctctgggagggcgggcacgatttgacggtggtggccggcgacgttaagggcgtgctgtcaaaggggaaacgcgccctggcgccgcccgtgaacgacttgaagtactcctggaagacctggggtaaagcgaagatcttcacccccgaggcgaagaacagcacctttttgatcgacgggccggatacgagcgagtgtcccaacgagagacgcgcatggaacttcttggaagtggaggattacggcttcgggatgttcacaaccaacatatggatgaagttccgcgagggctcgagcgaggtctgcgatcaccggctgatgtccgcggcgatcaaggaccagaaggccgtacacgcggatatgggctactggatcgagagctccaaaaaccagacctggcagatcgagaaggccagcttgatcgaggtcaagacgtgcctctggcccaagacacataccctatggtccaacggggtactcgagagccagatgctcattccgaaggcgtacgcgggccccttctcccagcacaactaccggcaggggtacgctacgcaaacggtcgggccctggcacctcgggaaactggagatcgacttcggagagtgtcccggcactaccgtgaccatccaggaagactgcgatcaccgaggtccaagcctccggaccacgacggcttccggcaagctggtgactcagtggtgttgtcgctcttgcaccatgccgcccttgcgcttcttgggcgaggatggctgctggtacgggatggaaatccggcccctgagcgagaaggaggagaacatggttaagtcccaggtcagcgccggacagggtacgtctgagacgttctccatggggcttctctgcctgaccctgttcgtggaggaatgcctccgccgccgcgtcacccggaagcacatgatcctggttgttgtgacgactctttgcgcaattatcctcggcggccttacctggatggacctactccgcgctctgattatgctgggcgacaccatgtccggacggatgggagggcagatccacttggccataatggccgtgttcaagatgagcccaggttacgtcctaggcatattcctgcgtaaacttacgtcccgggagaccgccctaatggttatcggtatggccatgaccaccgttctcagcatcccccacgacctcatggagttcatcgacggcatctccctgggcctaatcttactgaagatggtcactcacttcgacaacactcaggtgggaaccttagcgctatcgctgacttttatccgctcaaccatgcccttggtaatggcttggcgtaccatcatggccgtcctttttgtggtgacccttatccccctgtgccgcaccagctgcctacagaagcagtcccactgggtcgagataacggcattgatcttaggggcgcaggccctcccggtgtaccttatgaccttaatgaaaggggccagcaagcgttcgtggcccttaaacgagggcatcatggccgtggggctggtctctttgctcggctccgccttgctgaaaaacgacgttcccttagcgggccccatggtcgcagggggcctgctgcttgccgcctatgtcatgagcgggtccagcgccgacctcagcctcgagaaggccgcaaacgtccagtgggatgagatggccgatatcacaggctccagcccgatcatcgaggtgaagcaggacgaagatgggagtttcagcatccgcgacatcgaagagacgaacatgataactctcctggtcaagctggctctaataactgtgtccggcctctacccactagccatccccgtcaccatgactctctggtacatgtggcaggtcaagacgcagcggagcggcgccctgtgggacgtgccctcaccggccgcggcccagaaggcgaccctgaccgagggagtgtaccgcatcatgcagagaggcttattcgggaaaacccaggtcggcgtaggtatccacatggaaggtgtgttccacacgatgtggcatgtcacgagaggctccgtgatctgccacgagaccggaaggctggagcccagttgggcggacgtgcgcaacgatatgatatcttatggcgggggctggcggctgggcgataaatgggacaaggaagaagacgtccaggtgctagccatcgagccggggaagaaccccaagcacgtgcaaacgaagccgggccttttcaagaccctcacgggggaaatcggcgctgtcacgctcgactttaagcccgggaccagcgggagccctatcatcaaccggaaggggaaggtgataggcctgtacggaaacggggttgtcactaagtccggggactacgtgtcggccatcacccaggcggagcgcaccggggagcctgactacgaggtggacgaagacatcttccgcaagaagcgcctgaccatcatggacctccacccaggcgcaggcaagaccaaaagaatcctcccctctattgtccgtgaagccctcaagcgccggctccggactctcatactggcacccacccgcgtggtggcggcggaaatggaggaggccctgcgggggctgccgatacgctaccagactccagcggtcaagagcgagcataccggtagggagatcgtggacctgatgtgccacgccacgttcaccacacgccttctctccagcacccgggtacccaactacaatctgatcgtcatggacgaggcccacttcactgacccctcaagtgtggccgctcgcgggtacatctctactcgggtggagatgggggaagccgccgccatatttatgaccgctacacccccaggcgccacggatccattcccccagtcaaacagccccattgaagacattgagcgcgaaatccctgagaggtcctggaacaccggtttcgactggatcaccgactaccagggcaagactgtctggtttgtcccatccatcaaggctgggaatgacatcgccaactgtttgcgcaagtccggtaagaaagtcatccagctcagccggaagacattcgataccgagtacccaaagacgaagctcaccgactgggatttcgtcgtcacgaccgacatctccgagatgggggcgaacttcagggcgggccgtgtcattgacccgcggcgctgtctgaagcccgttatcagcaccgacgggccagagcgggtgatcttggccggccccatccctgtcacccccgcctccgccgcccagcgacggggccgcatcgggcgaaaccccgcgcaggaagacgaccagtacgtctttagcggggaccccctaaagaacgacgaggatcacgcccactggacggaagccaagatgttgcttgacaacatctacactccggaggggatcatccctaccttattcggacctgagcgcgaaaagaaccaggcgatcgacggtgagttccggctgagaggtgagcagcggaaaacattcgtggagctgatgcgccggggcgacctgcccgtctggctatcctataaggtggcctcggccggtatctcgtataaggaccgcgagtggtgcttcacgggcgagcggaacaaccagatcctcgaagagaacatggaggtggagatatggacgcgcgagggggaaaagaagaagctgcgaccgaagtggctggacgcccgcgtctatgccgaccccatggccctcaaagacttcaaggagttcgcttccggccgcaagagcatcacccttgatatccttaccgagatagccagtctccctacatacctgtcttctcgggctaagctggccctcgataatatagtcatgctgcatactaccgaaagaggagggaaggcgtaccagcacgccctgaacgagctccctgaatcccttgaaacgctgatgcttgtagccctgttgggcgccatgaccgccgggatcttcttgttcttcatgcagggcaaggggataggcaagttgagcatgggcttaatcgctatcgccgtggcctcagggttgctttgggtggcggagattcagccacagtggatcgccgcttccatcatactggagttcttcctcatggtgctgttaatccccgagcccgagaaacagaggaccccgcaggacaatcaattaatctacgtcatcttaaccatcctgaccatcatcggattaatcgccgccaacgagatggggctgatcgagaagaccaagaccgacttcggcttttaccaagtgaaaacagaaacgacaatcctggacgtggacttacgccctgcctccgcctggacgctgtacgctgtggctaccacgatccttacacccatgctccggcacacgatagagaacaccagtgccaacctaagcctcgccgcgatcgcgaaccaggccgccgtgctcatggggctgggcaagggctggccgctgcatcgcatggacttaggggtaccgctgttagccatgggctgctactcccaggtcaatcccaccaccctcatcgcctctctggtgatgctgttagttcactacgccatcatcggacccggtttacaagccaaggccacgcgggaggcacaaaagcgcaccgcggccggcatcatgaaaaacccgactgtcgacgggatcaccgtgatcgacctcgagccgatcagctacgaccccaaattcgagaagcagctcggccaggtgatgctgctggtcctttgcgcggggcagctgctgctcatgcggactacatgggccttctgcgaagtgctcaccctagccaccggacccgtcctcacgctgtgggaggggaaccccggccgcttctggaacaccaccattgcggtctcgacggccaacattttccggggaagttatctggccggcgccggcctcgccttcagcctgatcaagaacgctcagacgccgcgccgagggaccggcactaccggggagacgcttggggaaaagtggaagaggcagctcaactctctggaccggaaggagttcgaagagtacaaacgctctggcatcctcgaggtggatcggaccgaggcgaagtccgctctcaaggatggctcaaagattaagcacgccgtgtcccgcggtagctcaaagatccggtggattgtcgagcgcgggatggtgaagcccaaggggaaggtggtagacttagggtgtggccggggcgggtggagctactacatggctaccctgaagaacgtgactgaagtgaagggctacactaaaggagggcccgggcacgaagaacccatccctatggccacctacggctggaacctcgtgaagctgcactcgggggtcgatgtgttctacaaacccacggagcaggtcgacaccttactctgtgacatcggggaaagcagctccaacccaaccatcgaggagggccgcacactgcgggtgctaaagatggtggaaccctggctaagcagtaagccggagttctgcattaaggtgctgaacccctacatgcccaccgtgatcgaagagttagagaagctccagcgcaaacacggcggcagccttgtgagatgccctctgtcccggaacagtacccacgagatgtattgggtgtctggcgtgagcgggaacatagtctcgagcgtgaacaccacgtctaaaatgctcctcaatagattcaccacccggcatcgcaagcccacctacgaaaaggatgtcgacctgggcgccggaacgcggtcggtatccaccgagaccgagaagccggacatgacaataatcggccgccggctgcagcgcctccaggaggagcacaaggagacgtggcactacgaccaggaaaatccgtaccggacgtgggcctaccacgggagctacgaagcgccgtccaccggcagcgcgagctctatggtgaacggcgtggtcaagctccttaccaagccctgggacgtcattcccatggtgacgcagctcgccatgaccgataccaccccctttgggcaacagagagtgtttaaggagaaggtggacacccgcacaccccagccgaagccaggcacccgaatggtgatgacgacgaccgccaactggctgtgggccctgctcggaaagaaaaagaaccccagactgtgcacacgcgaggagttcatttccaaggtcaggagcaacgccgcgatcggcgcggtgttccaggaggaacaagggtggactagcgcctctgaggccgtcaacgacagccgcttctgggaactggtcgacaaggagcgggcactccatcaggagggcaagtgcgagtcttgcgtgtataatatgatgggcaagcgcgagaaaaagctaggggagttcggccgggcaaaggggtctagggctatctggtacatgtggttaggagcgagattcctcgagttcgaggccttaggcttcctgaatgaagaccattggttcggccgcgagaactcctggagcggcgtggagggtgagggcttgcacagactggggtacatattggaggacattgataagaaagacggcgacctcatctatgcggacgacaccgccggctgggacactcggataacggaagatgacttactgaatgaggagctcatcactgagcaaatggcaccccaccataagatactggccaaagctatcttcaagctgacgtaccagaacaaggtcgtcaaggtcctccgcccgacccccaagggagccgtaatggacatcatatccagaaaggaccagcggggtagtggccaagtgggcacctacgggctgaatacatttacgaacatggaagtacaactgatccggcaaatggaagcagaaggggtcatcacccaggatgacatgcacaaccccaaagggctcaaggaacgcgtagagaaatggctgaaggagtgcggcgttgatcggctgaagcgcatggctatctccggcgacgattgcgtcgtgaagcctctcgacgagcggttcagcacctcccttctgttcttaaacgacatggggaaggtgcgcaaggatataccccagtgggagccatccaaaggatggaagaactggcaggaggtgcccttctgcagccaccacttccacaagatctttatgaaggacgggaggagcctggtggtgccgtgtcgcaaccaggacgagttaatcggccgggcgagaataagtcaaggcgccgggtggtcactacgagaaacggcgtgcctcggcaaggcttacgcccagatgtggtccctgatgtacttccacagacgagacctccgcctggccagcatggccatctgcagtgcggttcccacagaatggttcccgacctcacgcacgacctggagcatccacgcacaccaccaatggatgaccaccgaggacatgttgaaggtgtggaaccgcgtgtggattgaggacaatcccaacatgaccgacaagaccccggtacactcctgggaggatatcccctacctcgggaagagagaggatctatggtgtggcagcctgatcgggctttccagtcgggccacctgggccaagaacattcacacggctataacacaggtgcgcaatctgatcgggaaggaggagtacgttgactacatgcccgtaatgaaacggtactccgccccatttgagagcgagggcgtgttatga

SEQ ID NO: 26346 - protein, 443 aa, synthetic construct
  REGION 1..443: note = derived and/or modified protein sequence (wt) from DENV-1 CYD23__SSm-EdelTM
MTQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGS

SEQ ID NO: 26347 - RNA, 1332 nt, synthetic construct
  misc_feature 1..1332: note = derived and/or modified CDS sequence (wt) from DENV-1 CYD23__SSm-EdelTM
  source 1..1332: mol_type = other RNA
atgacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttcttga

SEQ ID NO: 26348 - RNA, 1332 nt, synthetic construct
  misc_feature 1..1332: note = derived and/or modified CDS sequence (opt1) from DENV-1 CYD23__SSm-EdelTM
  source 1..1332: mol_type = other RNA
atgacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtcctga

SEQ ID NO: 26349 - RNA, 1332 nt, synthetic construct
  misc_feature 1..1332: note = derived and/or modified CDS sequence (opt1) from DENV-1 CYD23__SSm-EdelTM
  source 1..1332: mol_type = other RNA
atgacccagaagggcatcatcttcatcctgctcatgctggtgacccccagcatggccatgcgctgcgtcgggatcggctcccgggacttcgtggaggggctgagcggcgccacgtgggtggacgtcgtgctcgagcacgggtcctgcgtgaccaccatggcgaaggacaagccgaccctggacatcgagctgctcaagacggaggtcaccaaccccgccgtgctgcgcaagctgtgcatcgaggccaagatcagcaacaccaccacggactcccggtgccccacccagggcgaggccaccctcgtggaggagcaggacgccaacttcgtctgccgccggaccttcgtggaccgcggctgggggaacggctgcgggctgttcggcaaggggagcctgatcacgtgcgcgaagttcaagtgcgtgaccaagctcgagggcaagatcgtccagtacgagaacctgaagtactccgtgatcgtgaccgtccacaccggcgaccagcaccaggtggggaacgagagcacggagcacggcaccaccgccaccatcacgccccaggccccgaccaccgagatccagctgaccgactacggggccctcacgctggactgcagcccccggaccggcctggacttcaacgagatggtgctcctgaccatgaaggagaagtcctggctggtccacaagcagtggttcctcgacctgcccctgccctggacctccggcgcgagcacgtcccaggagacctggaaccgccaggacctcctggtgaccttcaagaccgcccacgccaagaagcaggaggtggtcgtgctggggagccaggagggcgccatgcacacggccctcaccggggcgaccgagatccagacctccggcacgaccaccatcttcgccgggcacctgaagtgccggctgaagatggacaagctcaccctgaagggcatgagctacgtgatgtgcaccggctccttcaagctggagaaggaggtcgccgagacgcagcacgggaccgtgctcgtccagatcaagtacgagggcaccgacgccccgtgcaagatccccttcagcacccaggacgagaagggggtgacgcagaacggccgcctgatcaccgccaaccccatcgtgaccgacaaggagaagcccgtcaacatcgaggcggagccgcccttcggggagtcctacatcgtgatcggcgccggcgagaaggccctgaagctcagctggttcaagaaggggagctccatcggcaagatgttcgaggccaccgcccgcggggcgcggcggatggccatcctgggcgacacggcctgggacttcgggagctga

SEQ ID NO: 26350 - RNA, 1332 nt, synthetic construct
  misc_feature 1..1332: note = derived and/or modified CDS sequence (opt2) from DENV-1 CYD23__SSm-EdelTM
  source 1..1332: mol_type = other RNA
atgacccagaagggcatcatcttcatcctcctcatgctcgtcaccccctccatggccatgcgctgcgtcggcatcggctcccgcgacttcgtcgagggcctctccggcgccacctgggtcgacgtcgtcctcgagcacggctcctgcgtcaccaccatggccaaggacaagcccaccctcgacatcgagctcctcaagaccgaggtcaccaaccccgccgtcctccgcaagctctgcatcgaggccaagatctccaacaccaccaccgactcccgctgccccacccagggcgaggccaccctcgtcgaggagcaggacgccaacttcgtctgccgccgcaccttcgtcgaccgcggctggggcaacggctgcggcctcttcggcaagggctccctcatcacctgcgccaagttcaagtgcgtcaccaagctcgagggcaagatcgtccagtacgagaacctcaagtactccgtcatcgtcaccgtccacaccggcgaccagcaccaggtcggcaacgagtccaccgagcacggcaccaccgccaccatcaccccccaggcccccaccaccgagatccagctcaccgactacggcgccctcaccctcgactgctccccccgcaccggcctcgacttcaacgagatggtcctcctcaccatgaaggagaagtcctggctcgtccacaagcagtggttcctcgacctccccctcccctggacctccggcgcctccacctcccaggagacctggaaccgccaggacctcctcgtcaccttcaagaccgcccacgccaagaagcaggaggtcgtcgtcctcggctcccaggagggcgccatgcacaccgccctcaccggcgccaccgagatccagacctccggcaccaccaccatcttcgccggccacctcaagtgccgcctcaagatggacaagctcaccctcaagggcatgtcctacgtcatgtgcaccggctccttcaagctcgagaaggaggtcgccgagacccagcacggcaccgtcctcgtccagatcaagtacgagggcaccgacgccccctgcaagatccccttctccacccaggacgagaagggcgtcacccagaacggccgcctcatcaccgccaaccccatcgtcaccgacaaggagaagcccgtcaacatcgaggccgagccccccttcggcgagtcctacatcgtcatcggcgccggcgagaaggccctcaagctctcctggttcaagaagggctcctccatcggcaagatgttcgaggccaccgcccgcggcgcccgccgcatggccatcctcggcgacaccgcctgggacttcggctcctga

SEQ ID NO: 26351 - RNA, 1332 nt, synthetic construct
  misc_feature 1..1332: note = derived and/or modified CDS sequence (opt3) from DENV-1 CYD23__SSm-EdelTM
  source 1..1332: mol_type = other RNA
atgacccagaagggcatcattttcatactgctcatgcttgtgacacccagcatggccatgagatgcgtcgggatcggatccagggactttgttgagggtctgtctggcgctacttgggtggatgtagtgttggaacacgggtcatgtgtcacgaccatggcaaaagacaagcctacattagatattgagctgctaaaaactgaagtgaccaacccagccgttctccggaagctgtgcatcgaggcgaaaattagtaatacaaccactgacagccgctgtccgacacaaggagaagctacccttgtggaggagcaggatgccaacttcgtctgccgacgtacgtttgtggacagaggctggggtaatgggtgtggactgttcggcaagggctccttgatcacttgcgcaaagtttaaatgtgtaaccaagctcgaagggaaaatagttcagtacgagaacctgaagtattctgtgatcgtcacagtgcatactggagatcagcaccaagtgggtaatgaatcgaccgagcatggcacaaccgccacgattactccccaggctcctacaaccgagatccagctgactgactacggggcactcacattagattgctcaccaaggaccggactggacttcaacgaaatggtccttttgacgatgaaagaaaagagctggctggttcacaagcagtggtttctagatctccccctgccttggaccagtggcgcctccacatctcaagagacttggaatcggcaggaccttctggtgaccttcaaaacagctcatgccaagaaacaggaggtagtggtcttgggtagccaggaaggggcgatgcacactgcactcaccggagccacagagattcaaacctccggcactacgacaatctttgctggccacctgaagtgtcgcttaaaaatggataagctgaccctcaaagggatgtcatatgtgatgtgcactggaagtttcaaacttgagaaggaagttgccgagacccagcatggtacagtgctggtccagataaagtacgaaggcaccgacgcaccatgtaagattccctttagcactcaagacgagaaaggggtgacacagaacggaagattgatcacggctaatcctattgtaaccgataaggaaaaaccagttaacatcgaggccgagccgcccttcggcgaatcttatatcgtgattggtgcgggggagaaggccctaaagctgtcctggtttaaaaagggctcaagcataggaaaaatgttcgaagcaactgctaggggcgcccggcgcatggctatcctcggggacacagcctgggatttcggaagttga

SEQ ID NO: 26352 - RNA, 1332 nt, synthetic construct
  misc_feature 1..1332: note = derived and/or modified CDS sequence (opt4) from DENV-1 CYD23__SSm-EdelTM
  source 1..1332: mol_type = other RNA
atgacccagaagggcatcatcttcatcctgctgatgctggtgacccccagcatggccatgagatgcgtgggcatcggcagcagagacttcgtggagggcctgagcggcgccacctgggtggacgtggtgctggagcacggcagctgcgtgaccaccatggccaaggacaagcccaccctggacatcgagctgctgaagaccgaggtgaccaaccccgccgtgctgagaaagctgtgcatcgaggccaagatcagcaacaccaccaccgacagcagatgccccacccagggcgaggccaccctggtggaggagcaggacgccaacttcgtgtgcagaagaaccttcgtggacagaggctggggcaacggctgcggcctgttcggcaagggcagcctgatcacctgcgccaagttcaagtgcgtgaccaagctggagggcaagatcgtgcagtacgagaacctgaagtacagcgtgatcgtgaccgtgcacaccggcgaccagcaccaggtgggcaacgagagcaccgagcacggcaccaccgccaccatcaccccccaggcccccaccaccgagatccagctgaccgactacggcgccctgaccctggactgcagccccagaaccggcctggacttcaacgagatggtgctgctgaccatgaaggagaagagctggctggtgcacaagcagtggttcctggacctgcccctgccctggaccagcggcgccagcaccagccaggagacctggaacagacaggacctgctggtgaccttcaagaccgcccacgccaagaagcaggaggtggtggtgctgggcagccaggagggcgccatgcacaccgccctgaccggcgccaccgagatccagaccagcggcaccaccaccatcttcgccggccacctgaagtgcagactgaagatggacaagctgaccctgaagggcatgagctacgtgatgtgcaccggcagcttcaagctggagaaggaggtggccgagacccagcacggcaccgtgctggtgcagatcaagtacgagggcaccgacgccccctgcaagatccccttcagcacccaggacgagaagggcgtgacccagaacggcagactgatcaccgccaaccccatcgtgaccgacaaggagaagcccgtgaacatcgaggccgagccccccttcggcgagagctacatcgtgatcggcgccggcgagaaggccctgaagctgagctggttcaagaagggcagcagcatcggcaagatgttcgaggccaccgccagaggcgccagaagaatggccatcctgggcgacaccgcctgggacttcggcagctga

SEQ ID NO: 26353 - RNA, 1332 nt, synthetic construct
  misc_feature 1..1332: note = derived and/or modified CDS sequence (opt5) from DENV-1 CYD23__SSm-EdelTM
  source 1..1332: mol_type = other RNA
atgacccagaagggcatcattttcatcctgctcatgctggtgacacccagcatggccatgagatgcgtcgggattggatcccgggactttgttgagggcctttctggggctacgtgggtggatgtggtcctggaacacggaagctgtgtgaccacaatggccaaagacaagcctaccctcgatatcgagctgcttaaaacagaagttaccaacccggcggtgctgcgcaagctctgcattgaggctaaaatctccaatacaaccacggactctagatgtcccacccaaggcgaagccacactggtcgaggagcaggatgccaacttcgtgtgccggcgcacctttgttgacagagggtggggaaatggctgtggcctgttcgggaagggaagcctcatcacatgcgctaagtttaaatgtgtgaccaagctggaaggcaaaattgtccagtacgagaaccttaagtattccgtgatcgtgacggtccatacaggggatcagcaccaagttggaaatgaatctaccgagcatggcacaaccgccaccattacacctcaggctcccacgaccgagatccagctgacagactacggggccctcaccctggattgcagccctcggacaggacttgacttcaacgaaatggtgctgctcaccatgaaagagaagtcctggctggtgcacaagcagtggtttctggatctccccctgccttggacgagcggcgcgtctacatcccaagaaacctggaatcgccaggaccttctggtcaccttcaaaacagcccatgctaagaaacaggaggtggttgtgctcggcagccaggaaggggccatgcacaccgctctgacaggagccacggagattcaaacctctggcacaaccacaatctttgcggggcaccttaagtgtagactgaaaatggataagctcaccctgaaaggaatgtcctatgtcatgtgcacgggcagcttcaagctggagaaggaagtggccgagacccagcatgggacagttctcgtgcagattaaatacgaaggaaccgacgctccgtgtaagatccccttttctacacaagacgagaaaggcgtcacccagaacggccggctgatcacggccaatcctattgtgacagataaggaaaaacccgtcaacatcgaggctgagcctcccttcggggaatcctatattgtgatcggagccggcgagaaggcccttaagctgagctggtttaaaaaggggtcctctattggaaaaatgttcgaagctaccgcgcgcggcgccagacggatggctatcctcggggacacagcctgggatttcggcagctga

SEQ ID NO: 26354 - RNA, 1332 nt, synthetic construct
  misc_feature 1..1332: note = derived and/or modified CDS sequence (opt6) from DENV-1 CYD23__SSm-EdelTM
  source 1..1332: mol_type = other RNA
atgacgcaaaaaggaataatatttattttgctcatgcttgtaacaccaagcatggcaatgcgctgtgtaggaataggaagtagagacttcgtagaaggattaagtggagcaacatgggtagatgtagtattagaacacggaagttgtgtaacaacaatggcaaaagataaaccaaccctagacatagaattattaaaaacagaagtaactaacccagcagtattgagaaaactttgtattgaagcaaaaataagtaacacaacaacagacagtagatgtcctacacagggagaagcaacattagttgaagaacaagatgccaattttgtatgcagaaggacatttgtagacagaggatggggaaatggatgcggattatttggaaaaggtagtctaataacatgtgctaaattcaaatgcgtaacaaaattagaaggaaaaatagtccaatatgaaaacttgaagtatagtgtaatagtaactgtacatacaggggatcaacatcaagtaggaaacgaaagtacagaacacggtacaacagcaacaataacaccacaagctccaacgacagaaatacaattaacagattatggagcattaaccttagattgtagtcccagaacaggactagattttaatgagatggtactattaacaatgaaagaaaaatcatggttagtccataaacaatggtttctagatctaccactcccatggacaagcggagcctcaacatcacaagagacatggaatagacaagatttactagttacattcaaaacagcacacgctaaaaaacaagaagtagtagtgttaggaagccaagaaggtgcaatgcataccgcgctaacaggagcaacagaaatacaaacttcaggaactacaaccatatttgcaggacacttaaaatgtagattaaaaatggataaattaacactaaaaggcatgagttacgtaatgtgtacaggatcattcaaactagaaaaagaagtagctgaaacacaacatggtacagttttagtacaaatcaaatacgaaggaacagatgcaccatgcaaaatacctttcagtacacaagatgaaaaaggagtaacacaaaatggaagactaataacagcaaatccaatagtaacagataaagaaaaaccagttaatatagaagcagaaccaccattcggagaatcatatatagttattggagcaggagaaaaagcattaaaattatcctggtttaaaaaaggttctagtataggaaaaatgtttgaagcaacagcaagaggcgcaagaagaatggcaatactaggagacacagcatgggattttggaagttaa

SEQ ID NO: 26355 - RNA, 1332 nt, synthetic construct
  misc_feature 1..1332: note = derived and/or modified CDS sequence (opt11) from DENV-1 CYD23__SSm-EdelTM
  source 1..1332: mol_type = other RNA
atgacccaaaaaggcatcatcttcatcctcctcatgctcgtcacccccagcatggccatgcgctgcgtcggcatcggatcccgcgatttcgtagaaggactatcaggcgcaacctgggtagacgtagtcctcgaacacggcagctgcgtcaccaccatggccaaagacaaaccaaccctcgacatcgaactcctcaaaacagaagtgaccaaccccgccgtactgcgcaaactttgcatcgaagccaaaatatcaaacaccacaacagactcacgatgcccaacccaaggcgaagccacactcgtcgaagaacaagacgccaacttcgtctgccgccgtacattcgtagaccgaggctggggaaacggctgcggacttttcggcaaaggcagcctcataacttgcgccaaattcaaatgcgtcacaaaactcgaaggcaaaatcgtacaatacgaaaacctcaaatactccgtaatcgtcaccgtacacaccggagaccagcaccaagtaggaaacgaaagtacagaacacggcaccacagccaccatcaccccacaagcacccaccaccgaaatacaactcaccgactacggcgccctcactcttgactgctcaccccgcaccggtctcgacttcaacgaaatggtgctcctaacaatgaaagaaaagtcctggctcgtccacaaacaatggtttctagacctcccactcccctggacaagcggggccagcacctcccaagaaacatggaaccgacaagacctactcgtcaccttcaaaaccgcccacgccaagaaacaggaagtcgtcgtactaggatcccaggagggcgcaatgcacacggccctgacaggagcaaccgaaattcaaacgtccggcaccaccaccatattcgccggccacctcaaatgccgcctcaaaatggacaaactcaccctaaaaggaatgagctacgtcatgtgcaccggatccttcaaactcgagaaagaagtagccgaaacccaacacggaaccgtactcgtccaaatcaaatacgaaggcaccgacgcaccctgcaaaatccccttctccacccaagacgaaaaaggagtcacccaaaacggcagactaataaccgcaaaccccattgtaacagacaaagagaaacccgtcaacatagaagccgaacccccattcggagaaagctacatcgtcataggagcgggagaaaaagccctgaaactctcatggttcaaaaagggcagctccatcggcaaaatgttcgaagcaaccgcacgcggagcccgaagaatggcaatcctaggagacaccgcctgggacttcggaagctaa

SEQ ID NO: 26356 - RNA, 1549 nt, synthetic construct
  misc_feature 1..1549: note = mRNA product Design1 comprising derived and/or modified sequence from DENV-1 CYD23__SSm-EdelTM (CDS opt1)
  source 1..1549: mol_type = other RNA
gggagaaagcttaccatgacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 26357 - RNA, 1714 nt, synthetic construct
  misc_feature 1..1714: note = mRNA product Design2 comprising derived and/or modified sequence from DENV-1 CYD23__SSm-EdelTM (CDS opt1) R3543/R3544
  source 1..1714: mol_type = other RNA
ggggcgctgcctacggaggtggcagccatctccttctcggcatcaagcttaccatgacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 26358 - protein, 14 aa, synthetic construct
  REGION 1..14: note = carrier peptide 1
CRRRRRRRRRRRRC

SEQ ID NO: 26359 - protein, 13 aa, synthetic construct
  REGION 1..13: note = carrier peptide 2
CRRRRRRRRRRRR

SEQ ID NO: 26360 - protein, 14 aa, synthetic construct
  REGION 1..14: note = carrier peptide 3
WRRRRRRRRRRRRC

SEQ ID NO: 26361 - protein, 18 aa, synthetic construct
  REGION 1..18: note = carrier peptide 4
CHHHHHHRRRRHHHHHHC
